(12) United States Patent
Brentjens et al.

(10) Patent No.: US 10,913,796 B2
(45) Date of Patent: Feb. 9, 2021

(54) ANTIBODIES TARGETING FC RECEPTOR-LIKE 5 AND METHODS OF USE

(71) Applicants: MEMORIAL SLOAN-KETTERING CANCER CENTER, New York, NY (US); EUREKA THERAPEUTICS, INC., Emeryville, CA (US)

(72) Inventors: Renier J. Brentjens, New York, NY (US); Eric L. Smith, New York, NY (US); Cheng Liu, Emeryville, CA (US)

(73) Assignees: MEMORIAL SLOAN-KETTERING CANCER CENTER, New York, NY (US); EUREKA THERAPEUTICS, INC., Emeryville, CA (US)

( * ) Notice: Subject to any disclaimer, the term of this patent is extended or adjusted under 35 U.S.C. 154(b) by 174 days.

(21) Appl. No.: 15/997,155

(22) Filed: Jun. 4, 2018

(65) Prior Publication Data

US 2018/0371085 A1 Dec. 27, 2018

Related U.S. Application Data

(63) Continuation of application No. PCT/US2016/064550, filed on Dec. 2, 2016.

(60) Provisional application No. 62/263,586, filed on Dec. 4, 2015.

(51) Int. Cl.
| | | |
|---|---|---|
| C07K 16/00 | (2006.01) |
| C12P 21/08 | (2006.01) |
| A61K 39/395 | (2006.01) |
| A61K 39/40 | (2006.01) |
| A61K 39/00 | (2006.01) |
| C07K 16/28 | (2006.01) |
| A61K 47/64 | (2017.01) |
| A61K 47/68 | (2017.01) |
| A61P 35/00 | (2006.01) |

(52) U.S. Cl.
CPC .... *C07K 16/2803* (2013.01); *A61K 39/39558* (2013.01); *A61K 47/6415* (2017.08); *A61K 47/6425* (2017.08); *A61K 47/6803* (2017.08); *A61P 35/00* (2018.01); *C07K 16/283* (2013.01); *C07K 16/2809* (2013.01); *A61K 2039/572* (2013.01); *A61K 2039/585* (2013.01); *C07K 2317/21* (2013.01); *C07K 2317/31* (2013.01); *C07K 2317/34* (2013.01); *C07K 2317/622* (2013.01)

(58) Field of Classification Search
None
See application file for complete search history.

(56) References Cited

U.S. PATENT DOCUMENTS

| | | |
|---|---|---|
| 4,956,778 A | 9/1990 | Naito |
| 5,091,513 A | 2/1992 | Huston et al. |
| 5,132,405 A | 7/1992 | Huston et al. |
| 5,399,346 A | 3/1995 | Anderson et al. |
| 5,840,344 A | 11/1998 | Fukushima |
| 7,129,053 B1 | 10/2006 | Reiter et al. |
| 7,446,190 B2 | 11/2008 | Sadelain et al. |
| 8,344,111 B2 | 1/2013 | Bachmann et al. |
| 8,389,282 B2 | 3/2013 | Sadelain et al. |
| 8,399,645 B2 | 3/2013 | Campana et al. |
| 8,497,118 B2 | 7/2013 | Jensen |
| 8,802,374 B2 | 8/2014 | Jensen |
| 2005/0196754 A1 | 9/2005 | Drmanac et al. |
| 2010/0228007 A1 | 9/2010 | Hoogenboom et al. |
| 2010/0260748 A1 | 10/2010 | Elkins et al. |
| 2011/0171125 A1 | 7/2011 | Elkins et al. |
| 2014/0243504 A1 | 8/2014 | Davis et al. |
| 2015/0098900 A1 | 4/2015 | Ebens et al. |
| 2017/0275362 A1 | 9/2017 | Brentjens et al. |
| 2018/0371085 A1 | 12/2018 | Brentjens et al. |

FOREIGN PATENT DOCUMENTS

| | | |
|---|---|---|
| RU | 2412947 C2 | 2/2011 |
| WO | WO 2002/002641 A2 | 1/2002 |
| WO | WO 2006/034488 A2 | 3/2006 |
| WO | WO 2006/039238 A2 | 4/2006 |
| WO | WO 2006/076691 A2 | 7/2006 |
| WO | WO 2010/114940 A1 | 10/2010 |
| WO | WO 2014/087010 A1 | 6/2014 |
| WO | WO 2014/134165 A1 | 9/2014 |
| WO | WO 2014/191128 A1 | 12/2014 |
| WO | WO 2014/210064 A1 | 12/2014 |
| WO | WO 2015/142675 A2 | 9/2015 |
| WO | WO 2016/090337 A1 | 6/2016 |
| WO | WO 2017/096120 A1 | 6/2017 |

OTHER PUBLICATIONS

U.S. Appl. No. 15/614,108, (US 2017/0275362), filed Jun. 5, 2007, (Sep. 28, 2017).
U.S. Appl. No. 15/614,108, Apr. 2, 2020 Restriction Requirement.
U.S. Appl. No. 15/614,108, Aug. 3, 2020 Response to Restriction Requirement.
Colman, "Effects of amino acid sequence changes on antibody-antigen interactions," Research in Immunology, 145(1):33-36 (1994).
Kochenderfer et. al., "Adoptive transfer of syngeneic T cells transduced with a chimeric antigen receptor that recognizes murine CD19 can eradicate lymphoma and normal B cells," Blood, 116(19):3875-3886 (2010).
Long et al., "4-1BB Costimulation Ameliorates T cell Exhaustion Induced by Tonic Signaling of Chimeric Antigen Receptors," Nat Med 21(6):581-590 (2015).
Mariuzza et al., "The Structural Basis of Antigen-Antibody Recognition," Annual Review of Biophysis and Biophysical Chemistry, 16:139-159 (1987).
Roitt et al., Immunology, Moscow, "Mir", pp. 110-111 (2000) (in Russian with an English translation).
Rudikoff et al., "Single amino acid substitution altering antigen-binding specificity," Immunology, Proc. Natl. Acad. Sci. USA, 79:1979-1983 (1982).

(Continued)

*Primary Examiner* — Chun W Dahle
(74) *Attorney, Agent, or Firm* — Baker Botts L.L.P.

(57) ABSTRACT

The presently disclosed subject matter provides fully human antibodies or antigen-binding fragments thereof that bind to FcRL5 and methods of using the same.

44 Claims, 33 Drawing Sheets

Specification includes a Sequence Listing.

(56) References Cited

OTHER PUBLICATIONS

Sakahara et al. "Effect of DTPA Conjugation on the Antigen Binding Activity and Biodistribution of Monoclonal Antibodies Against α-Fetoprotein," J Nucl Med, 26:750-755 (1985).
Singer et al., Genes and Genomes, Moscow, "Mir", pp. 63-64 (1998) (in Russian with an English translation).
Thorpe et al., "The Preparation and Cytotoxic Properties of Antibody-Toxin Conjugates," Immunol. Rev., 62:119-158 (1982).
Thorpe, "Antibody Carriers of Cytotoxic Agents in Cancer Therapy: A Review," in Monoclonal Antibodies '84: Biological and Clinical Applications, Pinchera et al. (eds.), pp. 475-506 (1985).
Tomimatsu et al., "Production of Human Monoclonal Antibodies against FcεRIα by a Method Combining in Vitro Immunization with Phage Display," Biosci Biotechnol Biochem 73(7):1465-1469 (2009).
Allen, "Ligand-Targeted Therapeutics in Anticancer Therapy," Nat. Rev. Cancer 2:750763 (2002).
Altschul et al., "Basic Local Alignment Search Tool," J. Mol. Biol. 215:403-410 (1990).
Altschul et al., "Gapped BLAST and PSI-BLAST: a new generation of protein database search programs," Nucleic Acids Res. 25(17):3389-3402 (1997).
Arnon et al., "Monoclonal Antibodies for Immunotargeting of Drugs in Cancer Therapy," in Monoclonal Antibodies and Cancer Therapy, Reisfeld et al. (eds.), pp. 243-256 Alan R. Liss, Inc. (1985).
Azinovic et al., "Survival benefit associated with human anti-mouse antibody (HAMA) in patients with B-cell malignancies," Cancer Immunol. Immunother. 55:1451-1458 (2006).
Bird et al., "Single-Chain Antigen-Binding Proteins," Science 242(4877):423-426 (1988).
Brennan et al., "Preparation of Bispecific Antibodies by Chemical Recombination of Monoclonal," Science 229(4708):81-83 (1985).
Brown et al., "Tolerance to single, but not multiple, amino acid replacements in antibody V-H CDR2: A means of mmlmlzmg B cell wastage from somatic hypermutation?" The J Immunol, 156(9):3285-3291 (1996).
Caron et al., "Engineered Humanized Dimeric Forms of IgG are More Effective Antibodies," J. Exp. Med 176:1191-1195 (1992).
Cuesta et al., Multivalent antibodies: when design surpasses evolution, Trends in Biotechnology 28(7):355-362 (2010).
Flatman et al., "Process analytics for purification of monoclonal antibodies," J. Chromatogr. B 848:79-87 (2007).
Frigyesi et al., "Robust isolation of malignant plasma cells in multiple myeloma," Blood 123(9):1336-1340 (2014).
Garfall et al., "Immunotherapy with Chimeric Antigen Receptors for Multiple Myeloma," Discov Med., 17(91):37-46 (2014).
Gershoni et al., "Epitope mapping—The first step in developing epitope-based vaccines," Biodrugs, 21 (3): 145-156 (2007).
Glennie et al., "Preparation and performance of bispecific F(ab' gamma)2 antibody containing thioether-linked Fab' gamma fragments," J. Immunol. 139:2367-2375 (1987).
Harris et al., "Crystallographic Structure of an Intact IgG1 Monoclonal Antibody," Journal of Molecular Biology 275:861-872 (1998).
Hellstrom et al., "Antibodies for Drug Delivery," in Controlled Drug Delivery (2nd Ed.), Robinson et al. (eds.), pp. 623-653 (Marcel Dekker, Inc. 1987).
Karpovsky et al., "Production of Target-Specific Effector Cells Using Hetero-Cross-Linked Aggregates Containing Anti-Target Cell and Anti-Fcγ Receptor Antibodies," J. Exp. Med. 160:1686-1701 (1984).
Klechevsky et al., "Antitumor activity of immunotoxins with T-cell receptor-like specificity against human melanoma xenografts," Cancer Res. 68(15):6360-6367 (2008).
Koyko et al., "Immunology," translated from English, edited by N.B. Serebryanaya, Mosow, "Akademiya," 2008, p. 37 (in Russian).
Liu et al., "Heteroantibody duplexes target cells for lysis by cytotoxic T lymphocytes," PNAS USA 82:8648-8652 (1985).
McCafferty et al., "Phage antibodies: filamentous phage displaying antibody variable domains," Nature, 348:552-554 (1990).

Meyers et al., "Optimal alignments in linear space," Cabios 4(1): 11-17 (1988).
Needleman et al., "A General Method Applicable to the Search for Similarities in the Amino Acid Sequence of Two Proteins," J. Mol. Biol. 48:443-453 (1970).
Ozhegov et al. "Dictionary of a Russian Language: 80,000 words and phraseological expressions," 4th ed. Supplemented, Mosow, "OOO 'A TEMP'" 2006, p. 375.
Parkman R., "Clonal analysis of murine graft-vs-host disease. I. Phenotypic and functional analysis of T lymphocyte clones," J. Immunol. 136(10):3543-3548 (1986).
Pastan et al., "Overview Immunotoxins in cancer therapy," Curr. Opin. Investig. Drugs 3(7):1089-1091 (2002).
Paulus, "Preparation and Biomedical Applications of Bispecific Antibodies," Behring Inst. Mitt. 78:118-132 (1985).
Payne, "Progress in immunoconjugate cancer therapeutics ," Cancer Cell 3:207-212 (2003).
Persic et al., "An integrated vector system for the eukaryotic expression of antibodies or their fragments after selection from phage display libraries," Gene 187:9-18 (1997).
Tai et al., "Antibody-Based Therapies in Multiple Myeloma," Bone Marrow Research Article ID: 924058 14 pg. (2011).
Tang et al., "The Foxp3+ regulatory T cell: a jack of all trades, master of regulation," Nat Immunol 9(3):239-244 (2008).
Trail et al., "Monoclonal antibody drug immunoconjugates for targeted treatment of cancer," Cancer Immunol. Immunother. 52:328-337 (2003).
Ward et al., "Binding activities of a repertoire of single immunoglobulin variable domains secreted from *Escherichia coli*," Nature 341:544-546 (1989).
Yeger, L., "Clinical Immunology and Allergology" vol. 1, 219-222 Book (1990).
Zhong et al., "Chimeric antigen receptors combining 4-1BB and CD28 signaling domains augment PI$_3$kinase/AKT/Bcl-X$_L$ activation and CD8+ T cell-mediated tumor eradication," Mol Ther 18(2):413-420 (2010).
U.S. Appl. No. 15/614,108 (US 2017/0275362), filed Jun. 5, 2017 (Sep. 28, 2017).
Perez De La Lastra et al., "Epitope mapping of 10 monoclonal antibodies against the pig analogue of human membrane cofactor protein (MCP)," Immunology, 96:663-670 (1999).
Supplementary Partial European Search Report dated Sep. 30, 2019 in EP Application No. 16871553.
An et al., "Chromosome 1q21 gains confer inferior outcomes in multiple myeloma treated with bortezomib but copy number variation and percentage of plasma cells involved have no additional prognostic value," Haematologica 99(2):353-359 (2014).
Anderson, "Prospects for Human Gene Therapy," Science 226(4673):401-409 (1984).
Ausubel et al., Current Protocols in Molecular Biology, John Wiley & Sons Inc., New York, 2003.
Bataille et al., "The phenotype of normal, reactive and malignant plasma cells. Identification of "many and multiple myelomas" and of new targets for myeloma therapy," Haematologica 91:1234-1240 (2006).
Benton et al., "Screening λgt Recombinant Clones by Hybridization to Single Plaques in situ," Science 196(4286):180-182 (1977).
Bertilaccio et al., "Low-Dose Lenalidomide Improves CAR-Based Immunotherapy in CLL by Reverting T-Cell Defects In Vivo," Blood 122:4171 (2013).
Blömer et al., "Highly Efficient and Sustained Gene Transfer in Adult Neurons with a Lentivirus Vector," Journal of Virology 71(9):6641-6649 (1997).
Boissel et al., "Retargeting NK-92 cells by means of CD19- and CD20-specific chimeric antigen receptors compares favorably with antibody-dependent cellular cytotoxicity," Oncoimmunology, 2(10):e26527 (2013).
Boyd et al., "The Clinical Impact and Molecular Biology of del(17p) in Multiple Myeloma Treated with Conventional or Thalidomide-Based Therapy," Genes, Chromosomes & Cancer 50:765-774 (2011).

(56) References Cited

OTHER PUBLICATIONS

Bregni et al., "Human Peripheral Blood Hematopoietic Progenitors Are Optimal Targets of Retroviral-Mediated Gene Transfer," Blood 80(6):1418-1422 (1992).
Brentjens et al., "CD19-Targeted T Cells Rapidly Induce Molecular Remissions in Adults with Chemotherapy-Refractory Acute Lymphoblastic Leukemia," Science Translational Medicine 5:177ra38 (2013).
Brentjens et al., "Eradication of systemic B-cell tumors by genetically targeted human T lymphocytes co-stimulated by CD80 and interleukin-15," Nature Medicine 9(3):279-286 (2003).
Brentjens et al., "Genetically Targeted T Cells Eradicate Systemic Acute Lymphoblastic Leukemia Xenografts," Clin Cancer Res 13(18):5426-5435 (2007).
Brentjens et al., "Safety and persistence of adoptively transferred autologous CD19-targeted T cells in patients with relapsed or chemotherapy refractory B-cell leukemias," Blood 118(18):4817-4828 (2011).
Brigham et al., "Rapid Communication: In vivo Transfection of Murine Lungs with a Functioning Prokaryotic Gene Using a Liposome Vehicle," Am. J. Med. Sci. 298(4):278-281 (1989).
Brocks et al., "A TNF receptor antagonistic scFv, which is not secreted in mammalian cells, is expressed as a soluble mono- and bivalent scFv derivative in insect cells," Immunotechnology 3:173-184 (1997).
Cayouette et al., "Adenovirus-Mediated Gene Transfer of Ciliary Neurotrophic Factor Can Prevent Photoreceptor Degeneration in the Retinal Degeneration (rd) Mouse," Human Gene Therapy 8:423-430 (1997).
Cornetta et al., "Gene Transfer into Primates and Prospects for Gene Therapy in Humans," Progress in Nucleic Acid Research and Molecular Biology 36:311-322 (1987).
Danos et al., "Safe and efficient generation of recombinant retroviruses with amphotropic and ecotropic host ranges," Proc. Natl. Acad Sci. USA 85:6460-6464 (1988).
Davila et al., "Efficacy and Toxicity Management of 19-28z CAR T Cell Therapy in B Cell Acute Lymphoblastic Leukemia," Science Translational Medicine 6:224ra25 (2014).
Dement-Brown et al., "Fc receptor-like 5 promotes B cell proliferation and drives the development of cells displaying switched isotypes," Journal of Leukocyte Biology 91:5967 (2012).
Dudley et al., "Adoptive Cell Therapy for Patients with Metastatic Melanoma: Evaluation of Intensive Myeloablative Chemoradiation Preparative Regimens," J Clin Oncol 26(32):5233-5239 (2008).
Dupont et al., "Artificial Antigen-Presenting Cells Transduced with Telomerase Efficiently Expand Epitope-Specific, Human Leukocyte Antigen—Restricted Cytotoxic T Cells," Cancer Res 65(12):5417-5427 (2005).
Eglitis et al., "Retroviral Vectors for Introduction of Genes into Mammalian Cells," BioTechniques 6(7):608-614 (1988).
Elkins et al., "FcRL5 as a Target of Antibody-Drug Conjugates for the Treatment of Multiple Myeloma," Molecular Cancer Therapeutics 11(10):2222-2232 (2012).
Felgner et al., "Lipofection: A highly efficient, lipid-mediated DNA-transfection procedure," Proc. Natl. Acad. Sci. USA 84:7413-7417 (1987).
Fife et al., "Inhibition of T cell activation and autoimmune diabetes using a B cell surface-linked CTLA-4 agonist," J Clin Invest 116(8):2252-2261 (2006).
Franco et al., "Human Fc Receptor-Like 5 Binds Intact IgG via Mechanisms Distinct from Those of Fc Receptors," Journal of Immunology 190:5739-5746 (2013).
Friedman, "Progress toward Human Gene Therapy," Science 244(4910):1275-1281 (1989).
Gade et al., "Targeted Elimination of Prostate Cancer by Genetically Directed Human T Lymphocytes," Cancer Res 65(19):9080-9088 (2005).
Gahrton et al., "Allogeneic Bone Marrow Transplantation in Multiple Myeloma," Bone Marrow Transplantation in Multiple Myeloma, The New England Journal of Medicine 325(18):1267-1273 (1991).
Giomarelli et al., "Inhibition of thrombin-inducedplatelet aggregation using human single-chain Fv antibodies specific for TREM-like transcript-I," Thromb Haemost 97:955-963 (2007).
Gong et al., "Cancer Patient T Cells Genetically Targeted to Prostate-Specific Membrane Antigen Specifically Lyse Prostate Cancer Cells and Release Cytokines in Response to Prostate-Specific Membrane Antigen," Neoplasia 1(2):123-127 (1999).
Grunstein et al., "Colony hybridization: A method for the isolation of clofted DNAs that contain a specific gene," Proc. Nat. Acad. Sci., USA 72(10):3961-3965 (1975).
Guide to Molecular Cloning Techniques, Guide to Molecular Cloning Techniques, vol. 152, eds. Berger and Kimmel 1987, Academic Press, New York.
Hatzivassiliou et al., "IRTA1 and IRTA2, Novel Immunoglobulin Superfamily Receptors Expressed in B Cells and Involved in Chromosome 1q21 Abnormalities in B Cell Malignancy," Immunity 14:277-289 (2001).
Ho et al., "Inhibition of Cocaine Binding to the Human Dopamine Transporter by a Single Chain Anti-Idiotypic Antibody: Its Cloning, Expression and Functional Properties," BioChim Biophys Acta 1638(3):257-266 (2003).
Hollyman et al., "Manufacturing Validation of Biologically Functional T Cells Targeted to CD19 Antigen for Autologous Adoptive Cell Therapy," J Immunother 32:169-180 (2009).
Hughes et al., "Retroviral Gene Transfer to Primitive Normal and Leukemic Hematopoietic Cells Using Clinically Applicable Procedures," J. Clin. Invest. 89:1817-1824 (1992).
Hunder et al., "Treatment of Metastatic Melanoma with Autologous CD4+ T cells against NY-ESO-1," N Engl J Med 358:2698-2703 (2008).
Huston et al., "Protein engineering of antibody binding sites: Recovery of specific activity in an anti-digoxin single-chain Fv analogue produced in *Escherichia coli*," Proc. Natl. Acad. Sci. USA 85:5879-5883 (1988).
International Search Report dated Mar. 11, 2016 in International Application No. PCT/US15/64134.
International Search Report dated May 8, 2017 in International Application No. PCT/US16/64550.
Ise et al. "Sandwich ELISAs for soluble immunoglobulin superfamily receptor translocation-associated 2 (IRTA2)/FcRH5 (CD307) proteins in human sera," Clinical Chemistry and Laboratory Medicine 44(5):594-602 (2006).
Ise et al., "Elevation of Soluble CD307 (IRTA2/FcRH5) Protein in the Blood and Expression on Malignant Cells of Patients with Multiple Myeloma, Chronic Lymphocytic Leukemia, and Mantle Cell Lymphoma," Leukemia 21:169-174 (2007).
Ise et al., "Immunoglobulin Superfamily Receptor Translocation Associated 2 Protein on Lymphoma Cell Lines and Hairy Cell Leukemia Cells Detected by Novel Monoclonal Antibodies," Clinical Cancer Research 11:87-96 (2005).
Johnson, "Gene Therapy for Cystic Fibrosis," Chest 107:77S-83S (1995).
Kabat et al. Sequences of Proteins of Immunological Interest, vol. I, Fifth Edition, U.S. Department of Health and Human Services, NIH Publication No. 91-3242 (1991).
Kabat et al., Sequences of Proteins of Immunological Interest, 4th Edition, U. S. Department of Health and Human Services, National Institutes of Health (1987).
Kershaw et al., "Gene-Engineered T Cells as a Superior Adjuvant Therapy for Metastatic Cancer," J Immunol 173:2143-2150 (2004).
Kido et al., "Use of a retroviral vector with an internal opsin promoter to direct gene expression to retinal photoreceptor cells," Current Eye Research 15:833-844 (1996).
Kimmel, "Identification and Characterization of Specific Clones: Strategy for Confirming the Validity of Presumptive Clones," Methods in Enzymology 152:507-511 (1987).
Krause et al., "Antigen-dependent CD28 Signaling Selectively Enhances Survival and Proliferation in Genetically Modified Activated Human Primary T Lymphocytes," J. Exp. Med. 188(4):619-626 (1998).
Le Gal La Salle et al., "An Adenovirus Vector for Gene Transfer into Neurons and Glia in the Brain," Science 259(5097):988-990 (1993).

(56) References Cited

OTHER PUBLICATIONS

Ledbetter et al., "Agonistic Activity of a CD4O-Specific Single-Chain Fv Constructed from the Variable Regions of mAb G28-5," Crit Rev Immunol 17:427-435 (1997).
Lyddane et al., "Cutting Edge: CD28 Controls Dominant Regulatory T cell Activity during Active Immunization," J Immunol. 176:3306-3310 (2006).
Maher et al., "Human T-lymphocyte cytotoxicity and proliferation directed by a single chimeric TCRξ/CD28 receptor," Nat. Biotechnol. 20:70-75 (2002).
Miller et al., "Cloning and Expression of a Yeast Ubiquitin-Protein Cleaving Activity in *Escherichia coli*," Biotechnology 7:698-704 (1989).
Miller et al., "Generation of Helper-Free Amphotropic Retroviruses That Transduce a Dominant-Acting, Methotrexate-Resistant Dihydrofolate Reductase Gene," Mol Cell Biol. 5(3):431-437 (1985).
Miller et al., "Redesign of Retrovirus Packaging Cell Lines to Avoid Recombination Leading to Helper Virus Production," Mol. Cell. Biol. 6(8):2895-2902 (1986).
Miller, "Retrovirus Packaging Cells," Human Gene Therapy 1:5-14 (1990).
Miyoshi et al., "Stable and efficient gene transfer into the retina using an HIV-based lentiviral vector," Proc. Natl. Acad. Sci. USA 94:10319-10323 (1997).
Moen, "Directions in Gene Therapy," Blood Cells 17:407-416 (1991).
Moosmayer et al., "A single-chain TNF receptor antagonist is an effective inhibitor of TNF mediated cytotoxicity," Therapeutic Immunol 2:31-40 (1995).
Morgan et al., "Cancer Regression in Patients After Transfer of Genetically Engineered Lymphocytes," Science 314:126-129 (2006).
Morgan et al., "Case Report of a Serious Adverse Event Following the Administration of T cells Transduced with a Chimeric Antigen Receptor Recognizing ERBB2," Molecular Therapy 18(4):843-851 (2010).
Naldini et al., "In Vivo Gene Delivery and Stable Transduction of Nondividing Cells by a Lentiviral Vector," Science 272(5259):263-267 (1996).
Ono et al., "Plasmid DNAs directly injected into mouse brain with lipofectin can be incorporated and expressed by brain cells," Neuroscience Letters 117:259-263 (1990).
Panelli et al., "A Tumor-Infiltrating Lymphocyte from a Melanoma Metastasis with Decreased Expression of Melanoma Differentiation Antigens Recognizes MAGE-12," J Immunol 164:4382-4392 (2000).
Panelli et al., "Expansion of Tumor-T Cell Pairs from Fine Needle Aspirates of Melanoma Metastases," J Immunol 164:495-504 (2000).
Papanicolaou et al., "Rapid expansion of cytomegalovirus-specific cytotoxic T lymphocytes by artificial antigen-presenting cells expressing a single HLA allele," Blood 102:2498-2505 (2003).
Pegram et al., "Tumor-targeted T cells modified to secrete IL-12 eradicate systemic tumors without need for prior conditioning," Blood 119(18):4133-4141 (2012).
Peter et al., "Protective effects of an anti-melanocortin-4 receptor scFv derivative in lipopolysaccharide-induced cachexia in rats," J Cachexia Sarcopenia Muscle 4:79-88 (2013).
Peter et al., "scFv Single Chain Antibody Variable Fragment as Inverse Agonist of the β2-Adrenergic Receptor," J Biol. Chem 278(38):36740-36747 (2003).
Riviere et al., "Novel Strategies for Cancer Therapy: The Potential of Genetically Modified T Lymphocytes," Curr Hematol Rep 3:290-297 (2004).
Roberts et al., "Vaccination with CD20 peptides induces a biologically active, specific immune response in mice," Blood 99:3748-3755 (2002).
Rosenberg et al., "Adoptive cell transfer: a clinical path to effective cancer immunotherapy," Nat. Rev. Cancer 8:299-308 (2008).
Rosenberg et al., "Gene Transfer Into Humans—Immunotherapy of Patients With Advanced Melanoma, Using Tumor-Infiltrating Lymphocytes Modified by Retroviral Gene Transduction," N Engl J Med 323:570-578 (1990).
Sadelain et al., "Targeting Tumours With Genetically Enhanced T Lymphocytes," Nat Rev Cancer 3:35-45 (2003).
Sadelain et al., "The basic principles of chimeric antigen receptor (CAR) design," Cancer Discovery 3(4):388-398 (2013).
Sadelain et al., "The promise and potential pitfalls of chimeric antigen receptors," Curr Opin Immunol 21:215-223 (2009).
Sambrook, Fritsch and Maniatis, Molecular Cloning: A Laboratory Manual (2d ed.), CSH Press, 1989.
Sharp, "Gene Therapy," The Lancet 337:1277-1278 (1991).
Shaughnessy Jr., et al., "A validated gene expression model of high-risk multiple myeloma is defined by deregulated expression of genes mapping to chromosome 1," Blood 109(6):2276-2284 (2007).
Shen et al., "Engineering Peptide Linkers for scFv Immunosensors," Anal Chem. 80(6):1910-1917 (2008).
Shieh et al., "Transgenic Expression of Single-Chain Anti-CTLA-4 Fv on β Cells Protects Nonobese Diabetic Mice from Autoimmune Diabetes," J Immunol. 183:2277-2285 (2009).
Siegel et al., "Cancer Statistics, 2013," CA Cancer J Clin 63:11-30 (2013).
Stephan et al., "T cell-encoded CD80 and 4-1BBL induce auto- and transcostimulation, resulting in potent tumor rejection," Nat. Med 13(12):1440-1449 (2007).
Straubinger et al., "Liposomes as Carriers for Intracellular Delivery of Nucleic Acids," Methods in Enzymology 101:512-527 (1983).
Supplementary European Search Report dated Apr. 30, 2018 in Application No. EP 15864773.
Tolstoshev et al., "Gene expression using retroviral vectors," Current Opinion in Biotechnology 1:55-61 (1990).
Wahl et al., "Investigative Nuclear Medicine," J. Nucl Med. 24:316-325 (1983).
Wahl et al., "Molecular Hybridization of Immobilized Nucleic Acids: Theoretical Concepts and Practical Considerations," Methods Enzymol. 152:399-407 (1987).
Wolff et al., "Direct Gene Transfer into Mouse Muscle in Vivo," Science 247(4949):1465-1468 (1990).
Wu et al., "Receptor-mediated Gene Delivery and Expression in Vivo," Journal of Biological Chemistry 263(29):14621-14624 (1988).
Wu et al., "Targeting Genes: Delivery and Persistent Expression of a Foreign Gene Driven by Mammalian Regulatory Elements in Vivo," Journal of Biological Chemistry 264(29):16985-16987 (1989).
Xie et al., "Direct demonstration of MuSK involvement in acetylcholine receptor clustering through identification of agonist ScFv," Nat Biotech 15:768-771 (1997).
Xu et al., "Correction of the enzyme deficiency in hematopoietic cells of Gaucher patients using a clinically acceptable retroviral supernatant transduction protocol," Exp. Hemat. 22:223-230 (1994).
Yasmina et al., "Probing the binding mechanism and affinity of tanezumab, a recombinant humanized anti-NGF monoclonal antibody, using a repertoire of biosensors," Protein Science 17:1326-1335 (2008).
Zhao et al., "Characteristics of an scFv Antibody Fragment That Binds to Immunoglobulin G of Graves' Disease Patients and Inhibits Autoantibody-Mediated Thyroid-Stimulating Activity," Hybridoma 27(6):445-451 (2008).

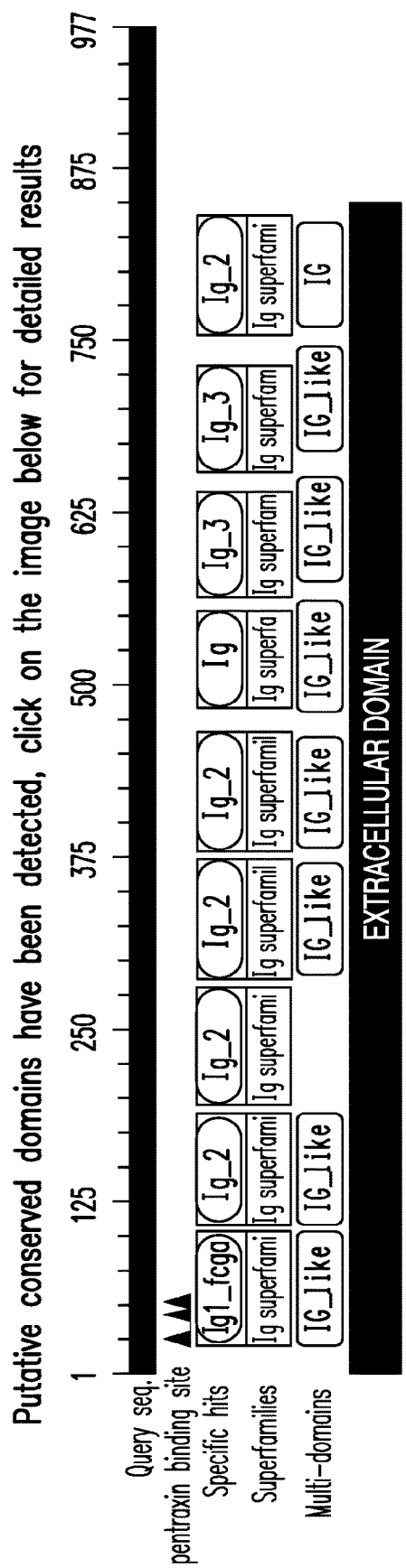
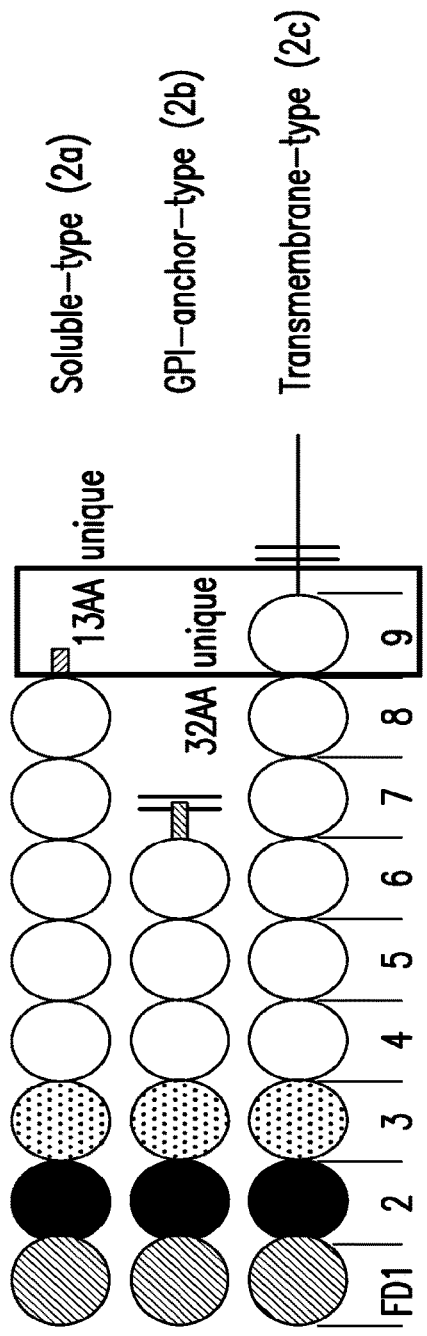
FIG. 3A

Domain 1-8
Domain 9
TM
Myc3

>MSK_delDOM9_myc_mCD8
MLLWVILLVLAPVSGQFARTPRPIIFLQPPWTTVFQGERVTLTCKGFRFYSPQKTKWYHRYLGKEILRET
PDNILEVQESGEYRCQAQGSPLSSPVHLDFSSASLILQAPLSVFEGDSVVLRCRAKAEVTLNNTIYKNDN
VLAFLNKRTDFHIPHACLKDNGAYRCTGYKESCCPVSSNTVKIQVQEPFTRPVLRASSFQPISGNPVTLT
CETQLSLERSDVPLRFRFFRDDQTLGLGWSLSPNFQITAMWSKDSGFYWCKAATMPHSIISDSPRSWIQV
QIPASHPVLTLSPEKALNFEGTKVTLHCETQEDSLRTLYRFYHEGVPLRHKSVRCERGASISFSLTTENS
GNYYCTADNGLGAKPSKAVSLSVTVPVSHPVLNLSSPEDLIFEGAKVTLHCEAQRGSLPILYQFHHEDAA
LERRSANSAGGVAISFSLTAEHSGNYYCTADNGFGPQRSKAVSLSITVPVSHPVLTLSSAEALTFEGATV
TLHCEVQRGSPQILYQFYHEDMPLWSSSTPSVGRVSFSFSLTEGHSGNYYCTADNGFGPQRSEVVSLFVT
VPVSRPILTLRVPRAQAVVGDLLELHCEAPRGSPPILYWFYHEDVTLGSSSAPSGGEASFNLSLTAEHSG
NYSCEANNGLVAQHSDTISLSVIVPVSRPILTFRAPRAQAVVGDLLELHCEALRGSSPILYWFYHEDVTL
GKISAPSGGGASFNLSLTTEHSGIYSCEADNGLEAQRSEMVTLKVAAAAEQKLISEEDLEQKLISEEDLE
QKLISEEDLTGVAGGLLSIAGLAAGALLLYCWLSRKAGRKPASDPARSPSDSDSQEPTYHNVPAWEELQP
VYTNANPRGENVVYSEVRIIQEKKKHAVASDPRHLRNKGSPIIYSEVKVASTPVSGSLFL
ASSAPHR*

>gi|14278719|gb|AAK50059.2|AF369794_1 B cell crosslinked IgM-activating
sequence protein [Homo sapiens]

MLLWVILLVLAPVSGQFARTPRPIIFLQPPWTTVFQGERVTLTCKGFRFYSPQKTKWYHRYLGKEILRET
PDNILEVQESGEYRCQAQGSPLSSPVHLDFSSASLILQAPLSVFEGDSVVLRCRAKAEVTLNNTIYKNDN
VLAFLNKRTDFHIPHACLKDNGAYRCTGYKESCCPVSSNTVKIQVQEPFTRPVLRASSFQPISGNPVTLT
CETQLSLERSDVPLRFRFFRDDQTLGLGWSLSPNFQITAMWSKDSGFYWCKAATMPHSIISDSPRSWIQV
QIPASHPVLTLSPEKALNFEGTKVTLHCETQEDSLRTLYRFYHEGVPLRHKSVRCERGASISFSLTTENS
GNYYCTADNGLGAKPSKAVSLSVTVPVSHPVLNLSSPEDLIFEGAKVTLHCEAQRGSLPILYQFHHEDAA
LERRSANSAGGVAISFSLTAEHSGNYYCTADNGFGPQRSKAVSLSITVPVSHPVLTLSSAEALTFEGATV
TLHCEVQRGSPQILYQFYHEDMPLWSSSTPSVGRVSFSFSLTEGHSGNYYCTADNGFGPQRSEVVSLFVT
VPVSRPILTLRVPRAQAVVGDLLELHCEAPRGSPPILYWFYHEDVTLGSSSAPSGGEASFNLSLTAEHSG
NYSCEANNGLVAQHSDTISLSVIVPVSRPILTFRAPRAQAVVGDLLELHCEALRGSSPILYWFYHEDVTL
GKISAPSGGGASFNLSLTTEHSGIYSCEADNGPEAQRSEMVTLKVAVPVSRPVLTLRAPGTHAAVGDLLE
LHCEALRGSPLILYRFFHEDVTLGNRSSPSGGASLNLSLTAEHSGNYSCEADNGLGAQRSETVTLYITGL
TANRSGPFATGVAGGLLSIAGLAAGALLLYCWLSRKAGRKPASDPARSPPDSDSQEPTYHNVPAWEELQP
VYTNANPRGENVVYSEVRIIQEKKKHAVASDPRHLRNKGSPIIYSEVKVASTPVSGSLFLASSAPHR

FIG. 3C

| | |
|---|---|
| MSK_delDOM9_myc3_mCD8 | MLLWVILLVLAPVSGQFARTPRPIIFLQPPWTTVFQGERVTLTCKGFRFYSPQKTKWYHR |
| gi\|14278719\|gb\|AAK50059.2\|AF3697 | MLLWVILLVLAPVSGQFARTPRPIIFLQPPWTTVFQGERVTLTCKGFRFYSPQKTKWYHR |
| MSK_delDOM9_myc3_mCD8 | YLGKEILRETPDNILEVQESGEYRCQAQGSPLSSPVHLDFSSASLILQAPLSVFEGDSVV |
| gi\|14278719\|gb\|AAK50059.2\|AF3697 | YLGKEILRETPDNILEVQESGEYRCQAQGSPLSSPVHLDFSSASLILQAPLSVFEGDSVV |
| MSK_delDOM9_myc3_mCD8 | LRCRAKAEVTLNNTIYKNDNVLAFLNKRTDFHIPHACLKDNGAYRCTGYKESCCPVSSNT |
| gi\|14278719\|gb\|AAK50059.2\|AF3697 | LRCRAKAEVTLNNTIYKNDNVLAFLNKRTDFHIPHACLKDNGAYRCTGYKESCCPVSSNT |
| MSK_delDOM9_myc3_mCD8 | VKIQVQEPFTRPVLRASSFQPISGNPVTLTCETQLSLERSDVPLRFRFFRDDQTLGLGWS |
| gi\|14278719\|gb\|AAK50059.2\|AF3697 | VKIQVQEPFTRPVLRASSFQPISGNPVTLTCETQLSLERSDVPLRFRFFRDDQTLGLGWS |
| MSK_delDOM9_myc3_mCD8 | LSPNFQITAMWSKDSGFYWCKAATMPHSIISDSPRSWIQVQIPASHPVLTLSPEKALNFE |
| gi\|14278719\|gb\|AAK50059.2\|AF3697 | LSPNFQITAMWSKDSGFYWCKAATMPHSVISDSPRSWIQVQIPASHPVLTLSPEKALNFE |
| MSK_delDOM9_myc3_mCD8 | GTKVTLHCETQEDSLRTLYRFYHEGVPLRHKSVRCERGASISFSLTTENSGNYYCTADNG |
| gi\|14278719\|gb\|AAK50059.2\|AF3697 | GTKVTLHCETQEDSLRTLYRFYHEGVPLRHKSVRCERGASISFSLTTENSGNYYCTADNG |
| MSK_delDOM9_myc3_mCD8 | LGAKPSKAVSLSVTVPVSHPVLNLSSPEDLIFEGAKVTLHCEAQRGSLPILYQFHHEDAA |
| gi\|14278719\|gb\|AAK50059.2\|AF3697 | LGAKPSKAVSLSVTVPVSHPVLNLSSPEDLIFEGAKVTLHCEAQRGSLPILYQFHHEDAA |
| MSK_delDOM9_myc3_mCD8 | LERRSANSAGGVAISFSLTAEHSGNYYCTADNGFGPQRSKAVSLSITVPVSHPVLTLSSA |
| gi\|14278719\|gb\|AAK50059.2\|AF3697 | LERRSANSAGGVAISFSLTAEHSGNYYCTADNGFGPQRSKAVSLSITVPVSHPVLTLSSA |

FIG. 3D

| MSK_de1DOM9_myc3_mCD8 | EALTFEGATVTLHCEVQRGSPQILYQFYHEDMPLWSSTPSVGRVSFSFSLTEGHSGNYY |
| gi\|14278719\|gb\|AAK50059.2\|AF3697 | EALTFEGATVTLHCEVQRGSPQILYQFYHEDMPLWSSTPSVGRVSFSFSLTEGHSGNYY |

| MSK_de1DOM9_myc3_mCD8 | CTADNGFGPQRSEVVSLFVTVPVSRPILTLRVPRAQAVVGDLLELHCEAPRGSPPILYWF |
| gi\|14278719\|gb\|AAK50059.2\|AF3697 | CTADNGFGPQRSEVVSLFVTVPVSRPILTLRVPRAQAVVGDLLELHCEAPRGSPPILYWF |

| MSK_de1DOM9_myc3_mCD8 | YHEDVTLGSSSAPSGGEASFNLSLTAEHSGNYSCEANNGLVAQHSDTISLSVIVPVSRPI |
| gi\|14278719\|gb\|AAK50059.2\|AF3697 | YHEDVTLGSSSAPSGGEASFNLSLTAEHSGNYSCEANNGLVAQHSDTISLSVIVPVSRPI |

| MSK_de1DOM9_myc3_mCD8 | LTFRAPRAQAVVGDLLELHCEALRGSSPILYWFYHEDVTLGKISAPSGGASFNLSLTTE |
| gi\|14278719\|gb\|AAK50059.2\|AF3697 | LTFRAPRAQAVVGDLLELHCEALRGSSPILYWFYHEDVTLGKISAPSGGASFNLSLTTE |

| MSK_de1DOM9_myc3_mCD8 | HSGIYSCEADNGiEAQRSEMVTLKVAqqqqQkLIS——————————————————— |
| gi\|14278719\|gb\|AAK50059.2\|AF3697 | HSGIYSCEADNGpEAQRSEMVTLKVApvsRpVLTlrapgthaavgdllehcealrgsp |

| MSK_de1DOM9_myc3_mCD8 | —————————eedLeqkLiSEedleqkliSEedL——————————— |
| gi\|14278719\|gb\|AAK50059.2\|AF3697 | lilyrffhedvtlgnrsspsgggasLnlsLtAEhsgnysceaADngLgqqrsetvtlyitgl |

| MSK_de1DOM9_myc3_mCD8 | ——————TGVAGGLLSIAGLAAGALLLYCWLSRKAGRKPASDPARSPsDSDSQEPTYH |
| gi\|14278719\|gb\|AAK50059.2\|AF3697 | tanrsgpfaTGVAGGLLSIAGLAAGALLLYCWLSRKAGRKPASDPARSPpDSDSQEPTYH |

| MSK_de1DOM9_myc3_mCD8 | NVPAWEELQPVYTNANPRGENVVYSEVRIIQEKKKHAVASDPRHLRNKGSPIIYSEVKVA |
| gi\|14278719\|gb\|AAK50059.2\|AF3697 | NVPAWEELQPVYTNANPRGENVVYSEVRIIQEKKKHAVASDPRHLRNKGSPIIYSEVKVA |

| MSK_de1DOM9_myc3_mCD8 | STPVSGSLFLASSAPHR |
| gi\|14278719\|gb\|AAK50059.2\|AF3697 | STPVSGSLFLASSAPHR |

FIG. 3D (continued)

ET200-39
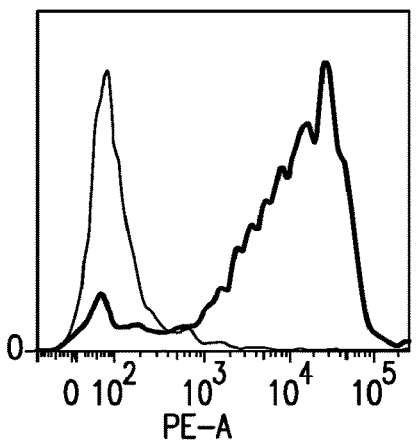
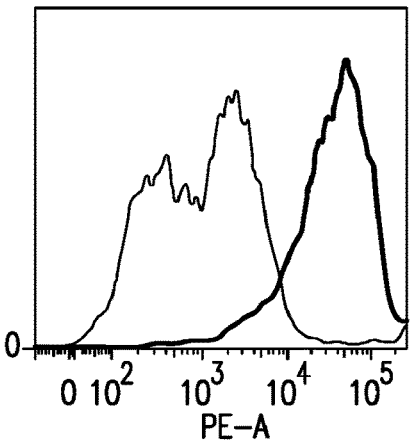
| Sample Name | Median, PE-A |
|---|---|
| D05+Raji-FcRL5.fcs | 1.11E4 |
| A04+Raji-FcRL5.fcs | 82.1 |
| Sample Name | Median, PE-A |
|---|---|
| D05+3T3-FcRL5.fcs | 3.76E4 |
| A04+3T3-FcRL5.fcs | 1137 |
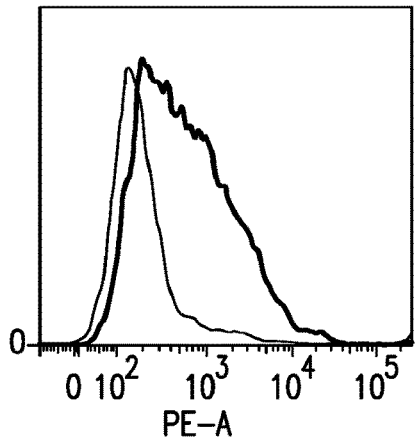
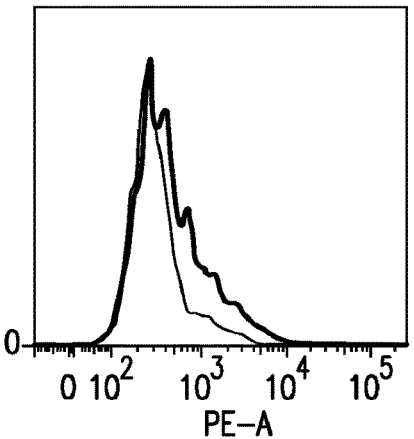
| Sample Name | Median, PE-A |
|---|---|
| D05+3T3-FcRL5-Delta.fcs | 496 |
| A04+3T3-FcRL5-Delta.fcs | 162 |
| Sample Name | Median, PE-A |
|---|---|
| D05+NIH 3T3.fcs | 379 |
| A04+NIH 3t3.fcs | 271 |
— Negative control phage
— ET200 phage
FIG.4

ET200-104
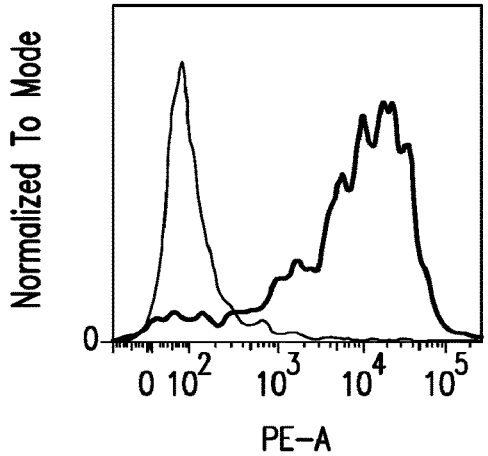
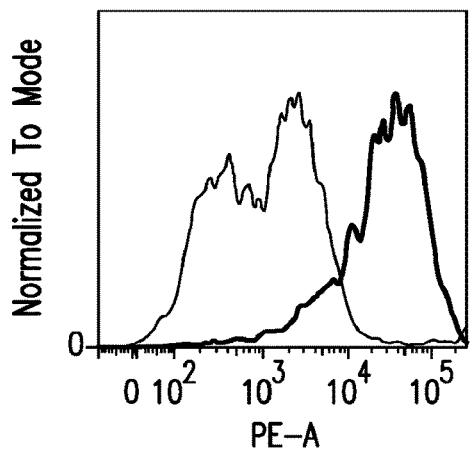
| | Sample Name | Median, PE-A |
|---|---|---|
| — | E11+Raji-FcRL5.fcs | 9165 |
| — | A04+Raji-FcRL5.fcs | 82.1 |
| | Sample Name | Median, PE-A |
|---|---|---|
| — | E11+3T3-FcRL5.fcs | 2.91E4 |
| — | A04+Raji-FcRL5.fcs | 1137 |
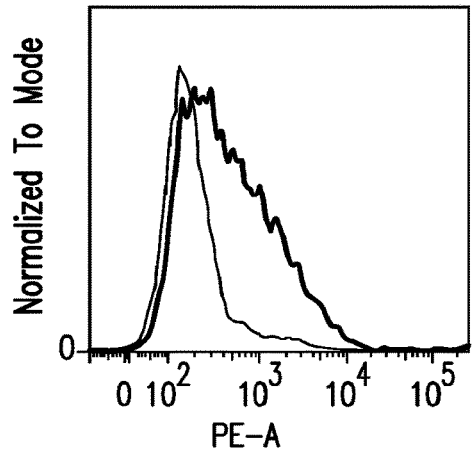
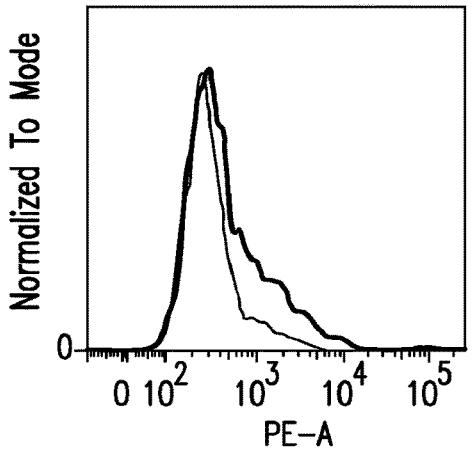
| | Sample Name | Median, PE-A |
|---|---|---|
| — | E11+3T3-FcRL5-Delta.fcs | 387 |
| — | A04+3T3-FcRL5-Delta.fcs | 162 |
| | Sample Name | Median, PE-A |
|---|---|---|
| — | E11+NIH 3T3.fcs | 360 |
| — | A04+NIH 3T3.fcs | 271 |
— Negative control phage
— ET200 phage
FIG. 5

ET200-105
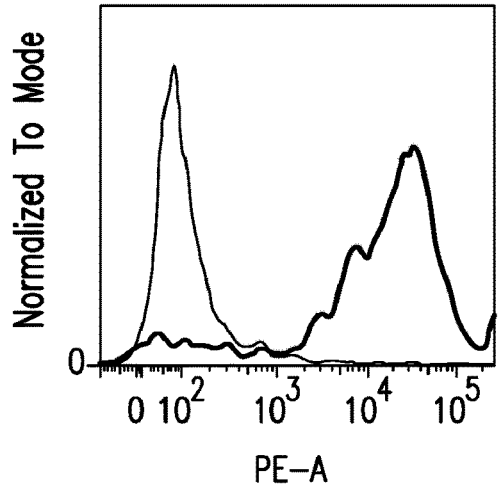
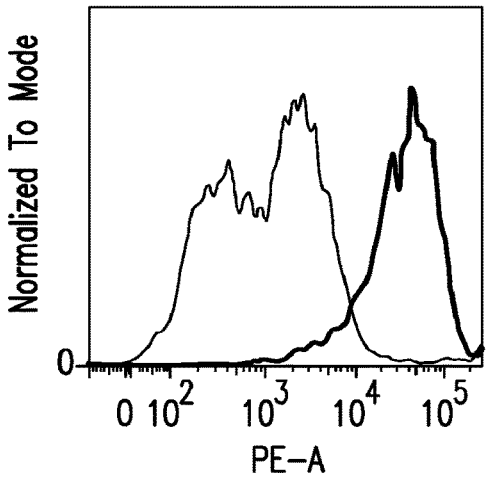
| Sample Name | Median, PE-A |
|---|---|
| —— E12+Raji-FcRL5.fcs | 1.80E4 |
| —— A04+Raji-FcRL5.fcs | 82.1 |
| Sample Name | Median, PE-A |
|---|---|
| —— E12+3T3-FcRL5.fcs | 3.52E4 |
| —— A04+3T3-FcRL5.fcs | 1137 |
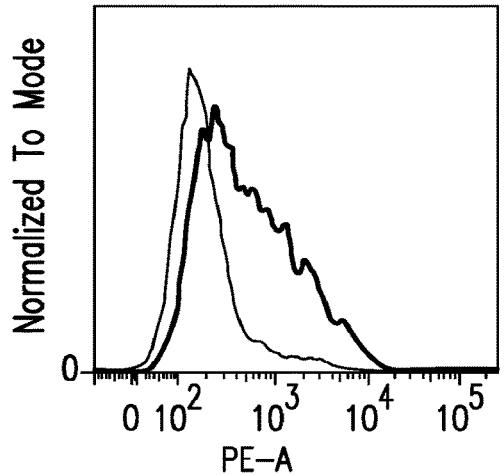
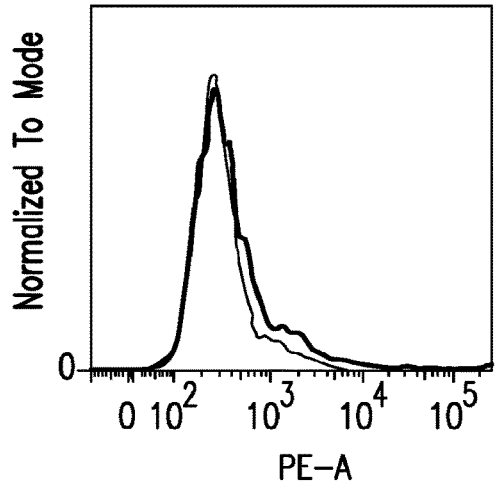
| Sample Name | Median, PE-A |
|---|---|
| —— E12+3T3-FcRL5-Delta.fcs | 415 |
| —— A04+3T3-FcRL5-Delta.fcs | 162 |
| Sample Name | Median, PE-A |
|---|---|
| —— E12+NIH 3T3.fcs | 309 |
| —— A04+NIH 3T3.fcs | 271 |
—— Negative control phage —— ET200 phage
FIG. 6

ET200-117
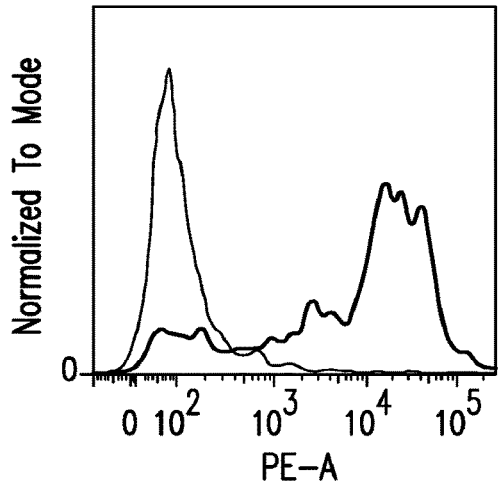
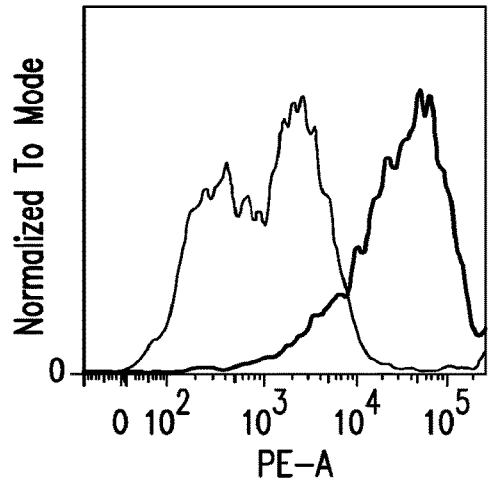
| | Sample Name | Median, PE-A |
|---|---|---|
| —— | F12+Raji-FcRL5.fcs | 1.27E4 |
| —— | A04+Raji-FcRL5.fcs | 82.1 |
| | Sample Name | Median, PE-A |
|---|---|---|
| —— | F12+3T3-FcRL5.fcs | 3.23E4 |
| —— | A04+3T3-FcRL5.fcs | 1137 |
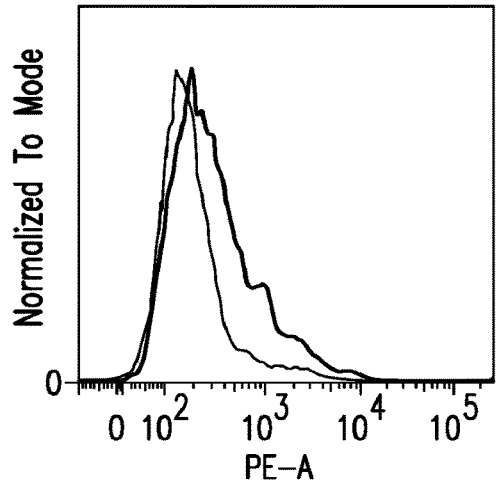
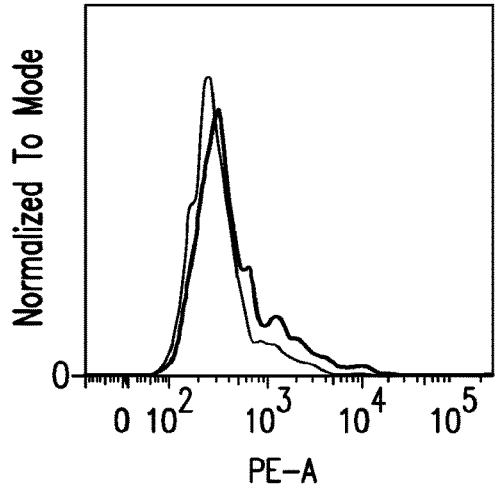
| | Sample Name | Median, PE-A |
|---|---|---|
| —— | F12+3T3-FcRL5-Delta.fcs | 260 |
| —— | A04+3T3-FcRL5-Delta.fcs | 162 |
| | Sample Name | Median, PE-A |
|---|---|---|
| —— | F12+NIH 3T3.fcs | 317 |
| —— | A04+NIH 3T3.fcs | 271 |
—— Negative control phage　　—— ET200 phage
FIG. 8

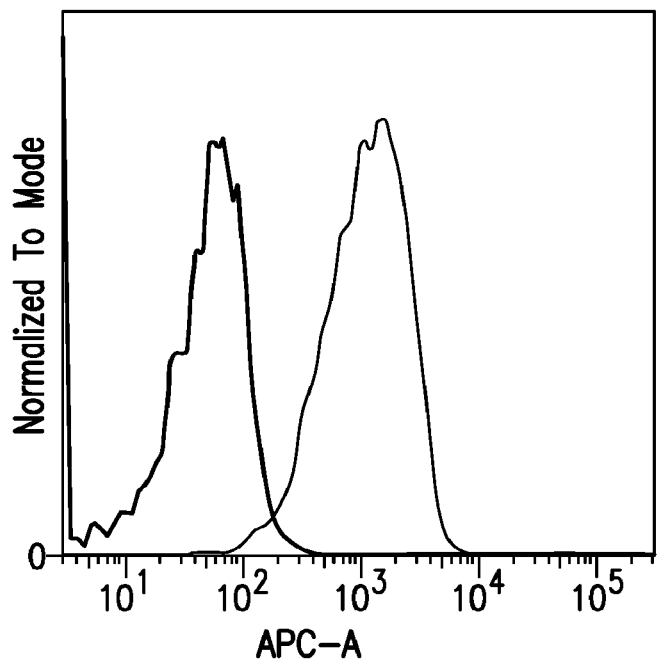
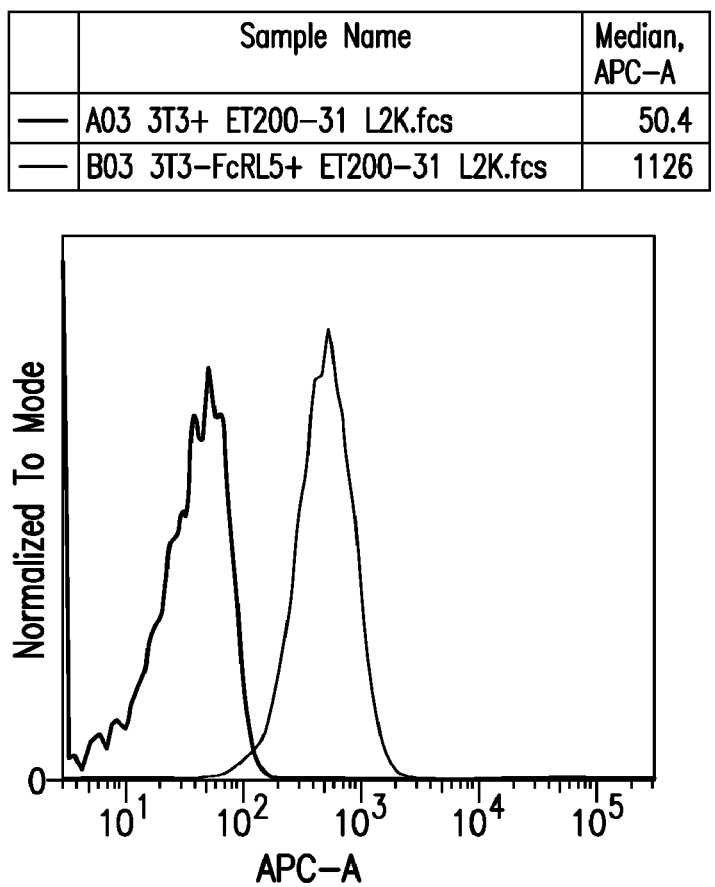
FIG. 9B

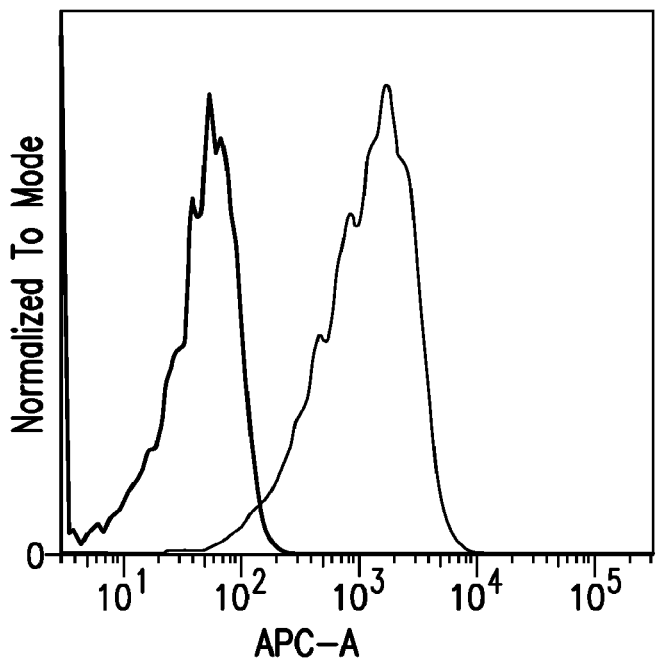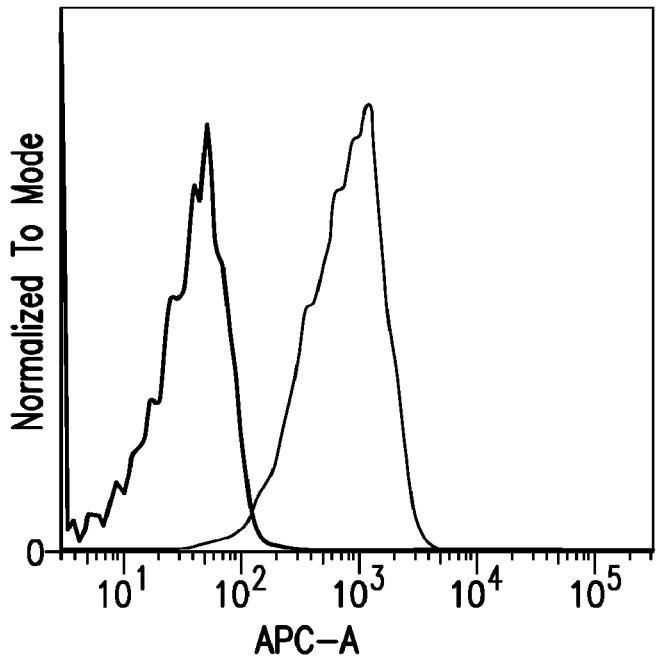
FIG. 9B (continued)

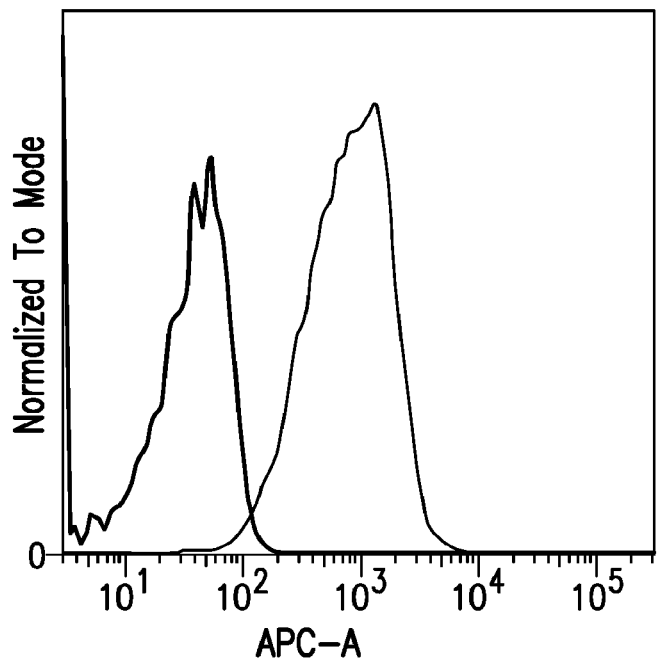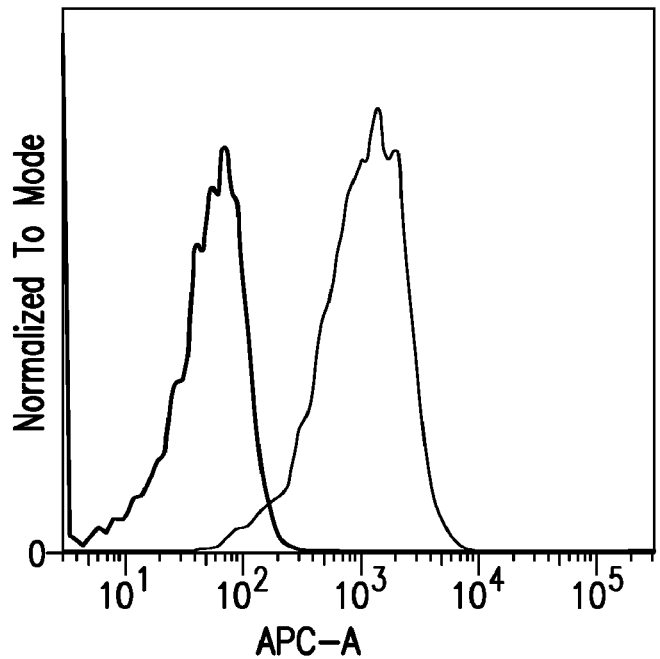
FIG. 9B (continued)

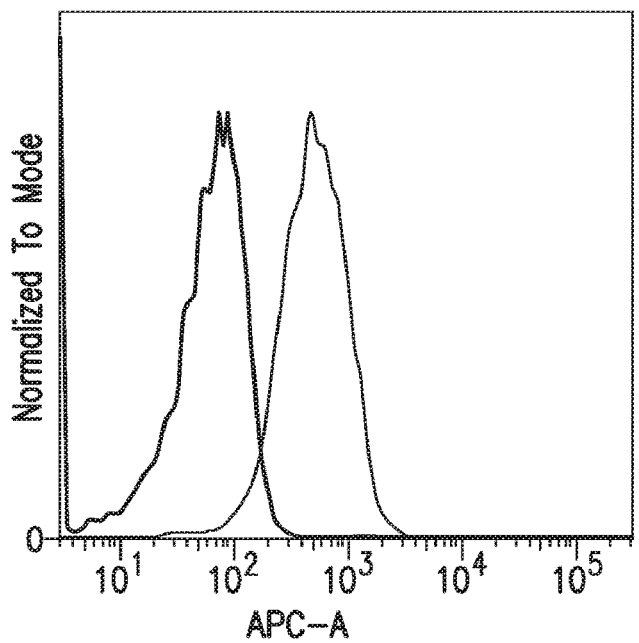
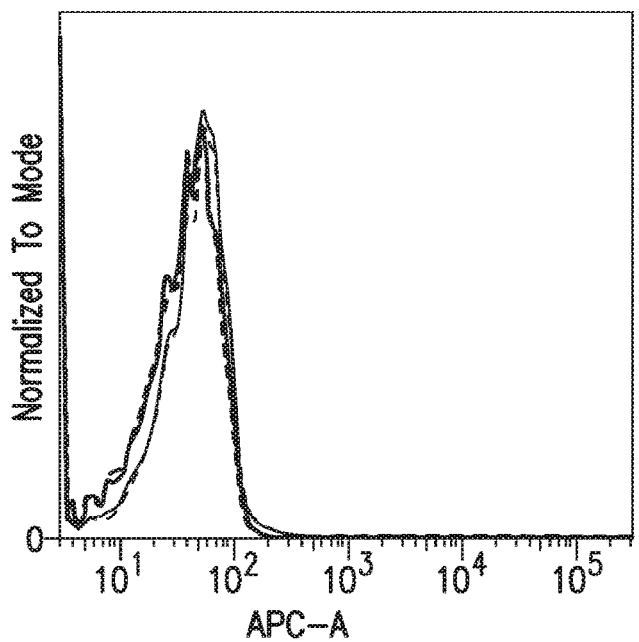
FIG. 9B (continued)

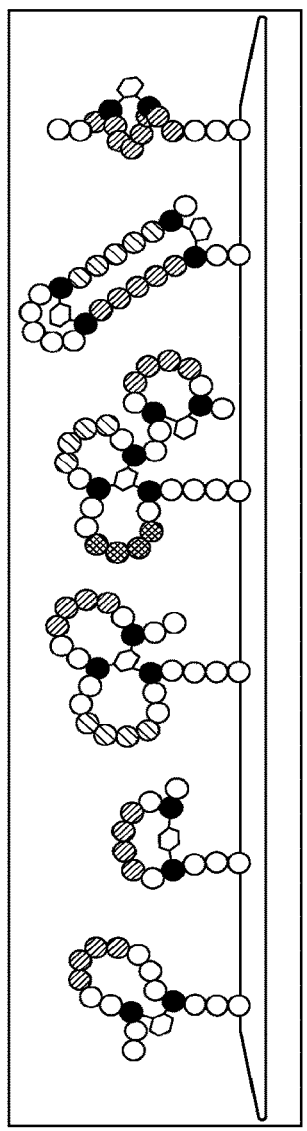
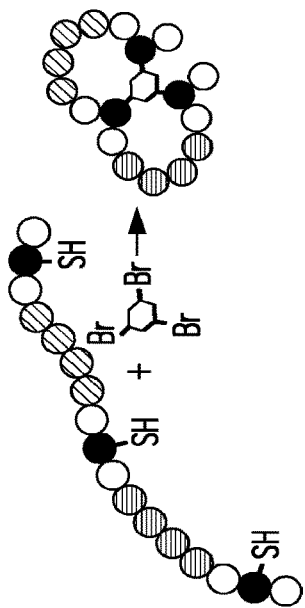
FIG. 10
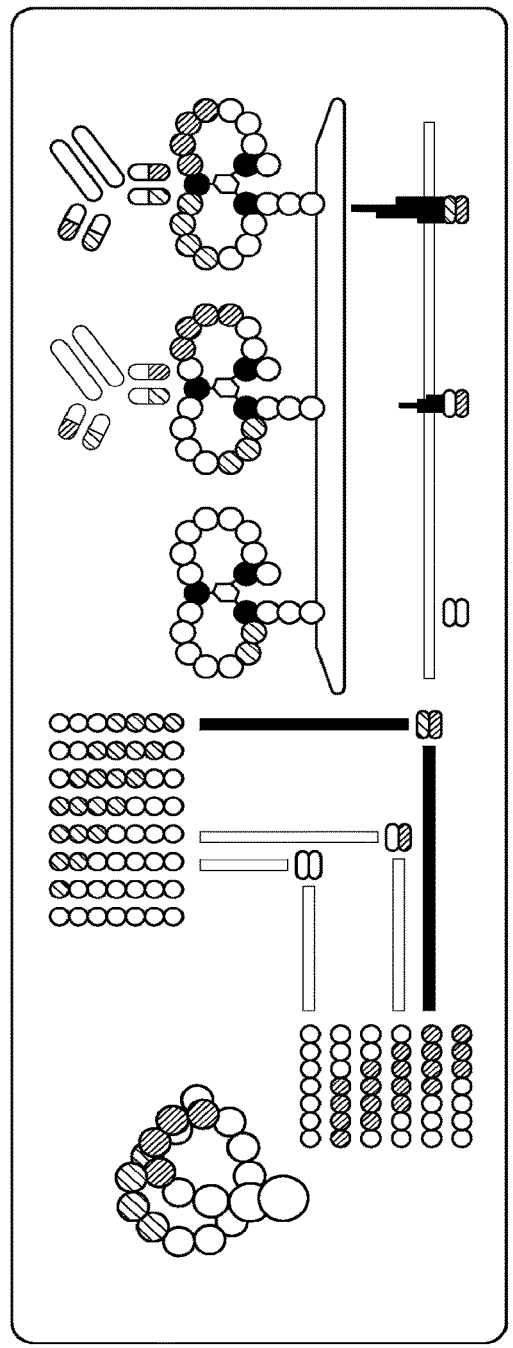
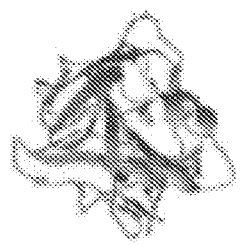
FIG. 11

| Loop 1 | Loop 2 | ELISA |
|---|---|---|
| CMDYDFKVKLSSERER | CWAIGCIFAELLTSEPC | −0.01 |
| CMDYDFKVKLSSERER | CCIFAELLTSEPIFHCC | 0.79 |
| CMDYDFKVKLSSERER | CELLTSEPIFHCRQEDC | 1.21 |
| CMDYDFKVKLSSERER | CSEPIFHCRQEDIKTSC | 0.36 |
| CFKVKLSSERERVEDL | CWAIGCIFAELLTSEPC | 0.17 |
| CFKVKLSSERERVEDL | CCIFAELLTSEPIFHCC | 1.19 |
| CFKVKLSSERERVEDL | CELLTSEPIFHCRQEDC | 1.24 |
| CFKVKLSSERERVEDL | CSEPIFHCRQEDIKTSC | 0.56 |
| CLSSERERVEDLFEYE | CWAIGCIFAELLTSEPC | 0.61 |
| CLSSERERVEDLFEYE | CCIFAELLTSEPIFHCC | 1.21 |
| CLSSERERVEDLFEYE | CELLTSEPIFHCRQEDC | 1.41 |
| CLSSERERVEDLFEYE | CSEPIFHCRQEDIKTSC | 0.58 |
| CRERVEDLFEYEGCKV | CWAIGCIFAELLTSEPC | 0.10 |
| CRERVEDLFEYEGCKV | CCIFAELLTSEPIFHCC | 0.83 |
| CRERVEDLFEYEGCKV | CELLTSEPIFHCRQEDC | 1.21 |
| CRERVEDLFEYEGCKV | CSEPIFHCRQEDIKTSC | −0.02 |

FIG. 13A

| Loop 1 | WAIGCIFAELLTSEP | CIFAELLTSEPIFHC | ELLTSEPIFHCRQED | SEPIFHCRQEDIKTS |
|---|---|---|---|---|
| MDYDFKVKLSSERER | −0.01 | 0.79 | 1.21 | 0.36 |
| FKVKLSSERERVEDL | 0.17 | 1.19 | 1.24 | 0.56 |
| LSSERERVEDLFEYE | 0.61 | 1.21 | 1.41 | 0.58 |
| RERVEDLFEYEGCKV | 0.10 | 0.83 | 1.21 | −0.02 |

FIG. 13B

low — Average — high

FIG. 13C

| | WAIGCIFAELLTSEP | CIFAELLTSEPIFHC | ELLTSEPIFHCRQED | SEPIFHCRQEDIKTS |
|---|---|---|---|---|
| MDYDFKVKLSSERER | | 0.79 | 1.21 | 0.36 |
| FKVKLSSERERVEDL | 0.17 | 1.19 | 1.24 | 0.56 |
| LSSERERVEDLFEYE | 0.61 | 1.21 | 1.41 | 0.58 |
| RERVEDLFEYEGCKV | 0.10 | 0.83 | 1.21 | |

ANTIBODIES TARGETING FC RECEPTOR-LIKE 5 AND METHODS OF USE

CROSS-REFERENCE TO RELATED APPLICATIONS

This application is a Continuation of International Patent Application No. PCT/US16/64550, filed Dec. 2, 2016, which claims priority to U.S. Provisional Patent Application Ser. No. 62/263,586, filed Dec. 4, 2015, the contents of each of which are incorporated by reference in their entirety, and to each of which priority is claimed.

SEQUENCE LISTING

The specification further incorporates by reference the Sequence Listing submitted herewith via EFS on Jun. 4, 2018. Pursuant to 37 C.F.R. § 1.52(e)(5), the Sequence Listing text file, identified as 0727340735SL.txt, is 950,965 bytes and was created on Jun. 4, 2018. The Sequence Listing electronically filed herewith, does not extend beyond the scope of the specification and thus does not contain new matter.

FIELD OF THE SUBJECT MATTER

The presently disclosed subject matter relates to fully human antibodies that bind to Fc Receptor-like 5 (FcRL5), and methods of using the same. The presently disclosed subject matter further relates to fully human antibodies that bind to domain 9 of FcRL5.

BACKGROUND OF THE SUBJECT MATTER

Fc receptor-like (FcRL) proteins are a family of cellular receptors homologous to FcγRI and are predominantly expressed by B cells. FcRL5 is expressed on both mature B cells and plasma cells, and is induced by Epstein-Barr virus (EBV) proteins (Polson et al., Int. Immunol. 18:1363-1373 (2006); Mohan et al., Blood. 107:4433-4439 (2006)). FcRL5 has been shown to inhibit B cell antigen receptor signaling and the co-stimulation of FcRL5 and the B cell antigen receptor promotes proliferation and differentiation of naive B cells (Dement-Brown et al., J. Leukoc. Biol. 91:59-67 (2012)). FcRL5 has been implicated in human diseases, including cancer and autoimmune conditions (Kochi et al. Nat. Genet. 37:478-485 (2005); Li et al. Blood. 112(1):179-87 (2008)). In particular, FcRL5 has been shown to be overexpressed on malignant B cells of hairy cell leukemia, chronic lymphocytic leukemia, mantle cell lymphoma and multiple myeloma patients (Polson et al., Int. Immunol. 18(9):1363-73 (2006); Li et al. (2008)). In addition, serum levels of soluble FcRL5 are elevated in patients with several types of B cell tumors (Ise et al., Leukemia. 21:169-174 (2007)). Given the significant association between FcRL5 and B cell cancers, therapeutics targeting FcRL5 are desired.

SUMMARY OF THE SUBJECT MATTER

The presently disclosed subject matter provides fully human antibodies that bind to Fc Receptor-like 5 (FcRL5), and methods of using the same. The presently disclosed subject matter further provides fully human antibodies that specifically bind domain 7, 8 or 9 of FcRL5. It is based, at least in part, on the discovery of 76 clones from a human phage display library that specifically bind to FcRL5.

In various non-limiting embodiments, the presently disclosed subject matter provides for antibodies, and particularly variable regions of antibodies, that bind specifically to human FcRL5, as well as nucleic acids encoding said antibodies and variable regions, vectors comprising said nucleic acids and methods of producing said antibodies. The presently disclosed subject matter further provides pharmaceutical compositions comprising the disclosed anti-FcRL5 antibodies and methods of treatment. 76 species of antibodies, as well as competitively binding antibodies, are provided.

BRIEF DESCRIPTION OF THE FIGURES

FIG. 3A-D. (A) A representation of the domains of FcRL5 and the soluble, glycosylphosphatidylinositol (GPI)-anchored and transmembrane forms of FcRL5. (B) A representation of the vector used to express a mutated form of FcRL5 that lacks domain 9 (also referred to herein as FcRL5Δdom9). (C) The nucleotide sequences of full length FcRL5 and the form of FcRL5 that lacks domain 9. (D) A representation of the differences in the nucleotide sequences of full length FcRL5 and the mutated form of FcRL5 in which domain 9 is deleted (referred to herein as "FcRL5Δdom9").

FIG. 5 depicts the screening of anti-FcRL5 scFv ET200-104 on 3T3 cells expressing FcRL5Δdom9.

FIG. 8 depicts the screening of anti-FcRL5 scFv ET200-117 on 3T3 cells expressing FcRL5Δdom9.

FIG. 9A-B depicts the FACS analysis of anti-FcRL5/CD3 bispecific antibodies.

FIG. 10 illustrates the CLIPS technology. The CLIPS reaction takes place between bromo groups of the CLIPS scaffold and thiol sidechains of cysteines. The reaction is fast and specific under mild conditions. Using this elegant chemistry, native protein sequences are transformed into CLIPS constructs with a range of structures. From left to right: two different single T2 loops, T3 double loop, conjugated T2+T3 loops, stabilized beta sheet, and stabilized alpha helix (Timmerman et al., J. Mol. Recognit. 2007; 20: 283-29).

FIG. 11 illustrates combinatorial clips library screening. The target protein (left) containing a discontinuous conformational epitope is converted into a matrix library (middle). Combinatorial peptides are synthesized on a proprietary minicard and chemically converted into spatially defined CLIPS constructs (right).

FIG. 13A-D illustrates heat map technology. (A) Table of combined peptides, with two sub-sequences indicated as "Loop 1" and "Loop 2." (B) Data from A displayed as a matrix. (C) Color bar indication of the heat map representation. (D) Heat map visualization of data from A.

DETAILED DESCRIPTION OF THE SUBJECT MATTER

Figure 1:
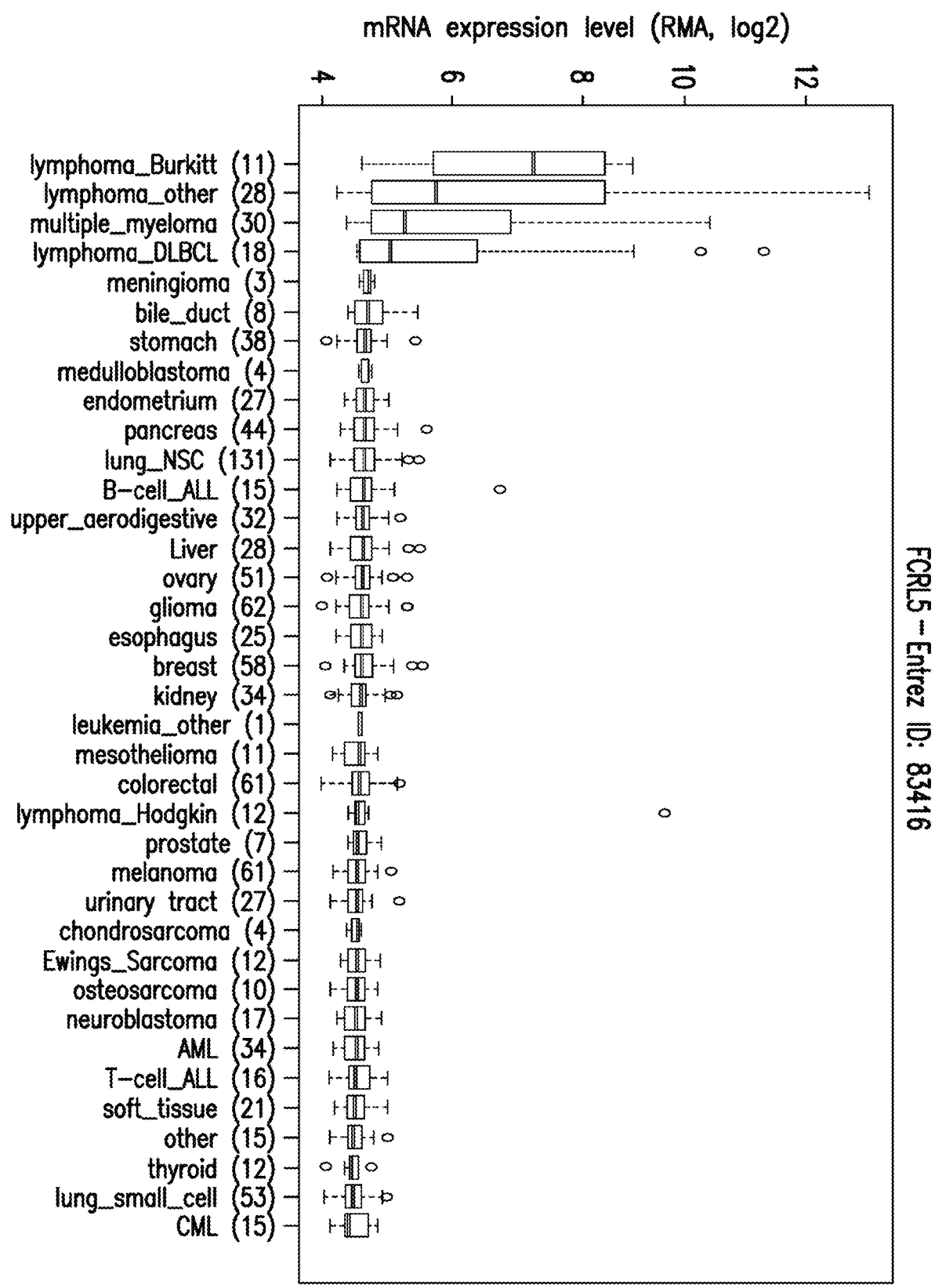
FIG. 1 depicts the FcRL5 expression in various normal tissues and human cancer cell lines.
Figure 1:
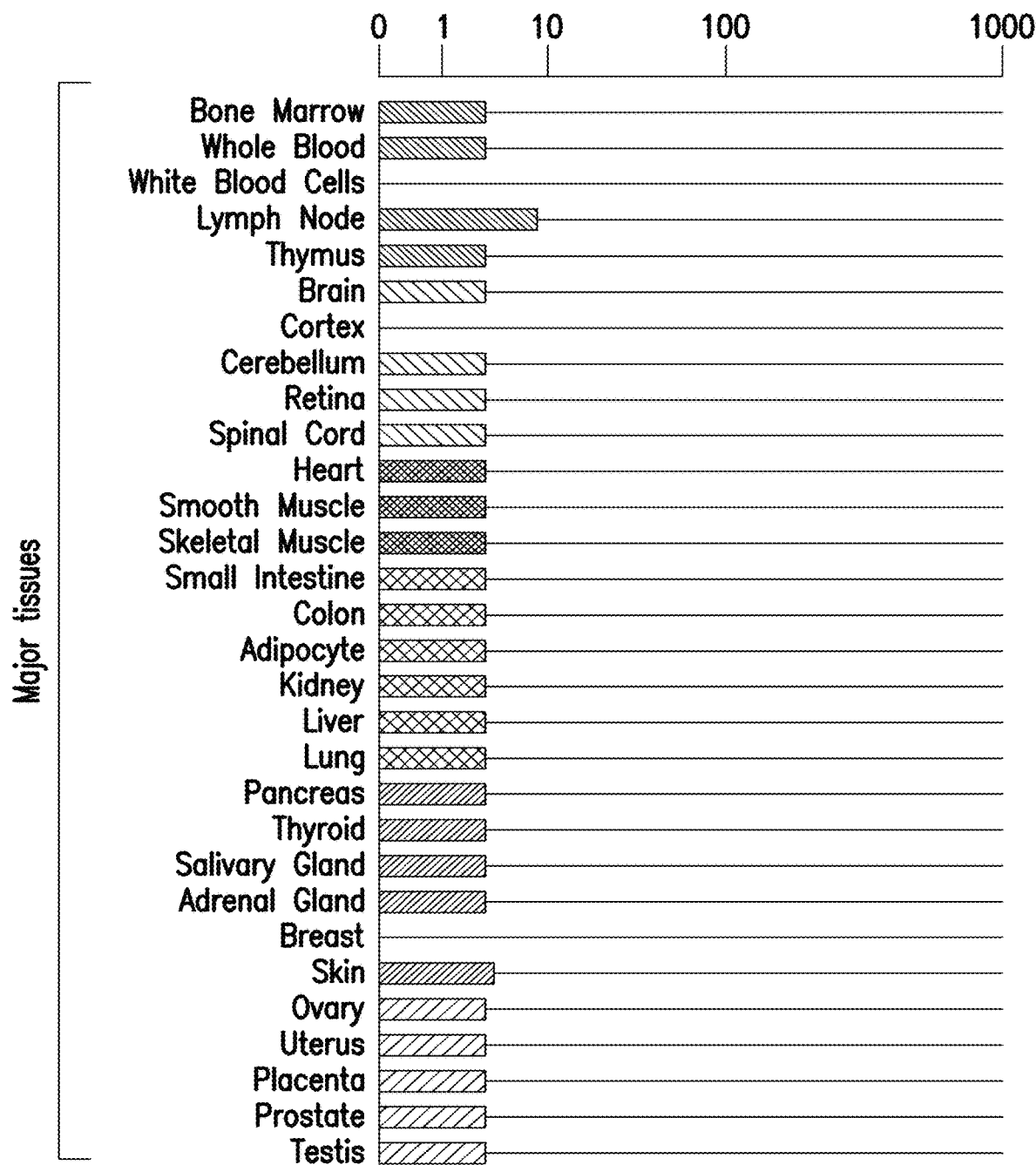
Figure 1:
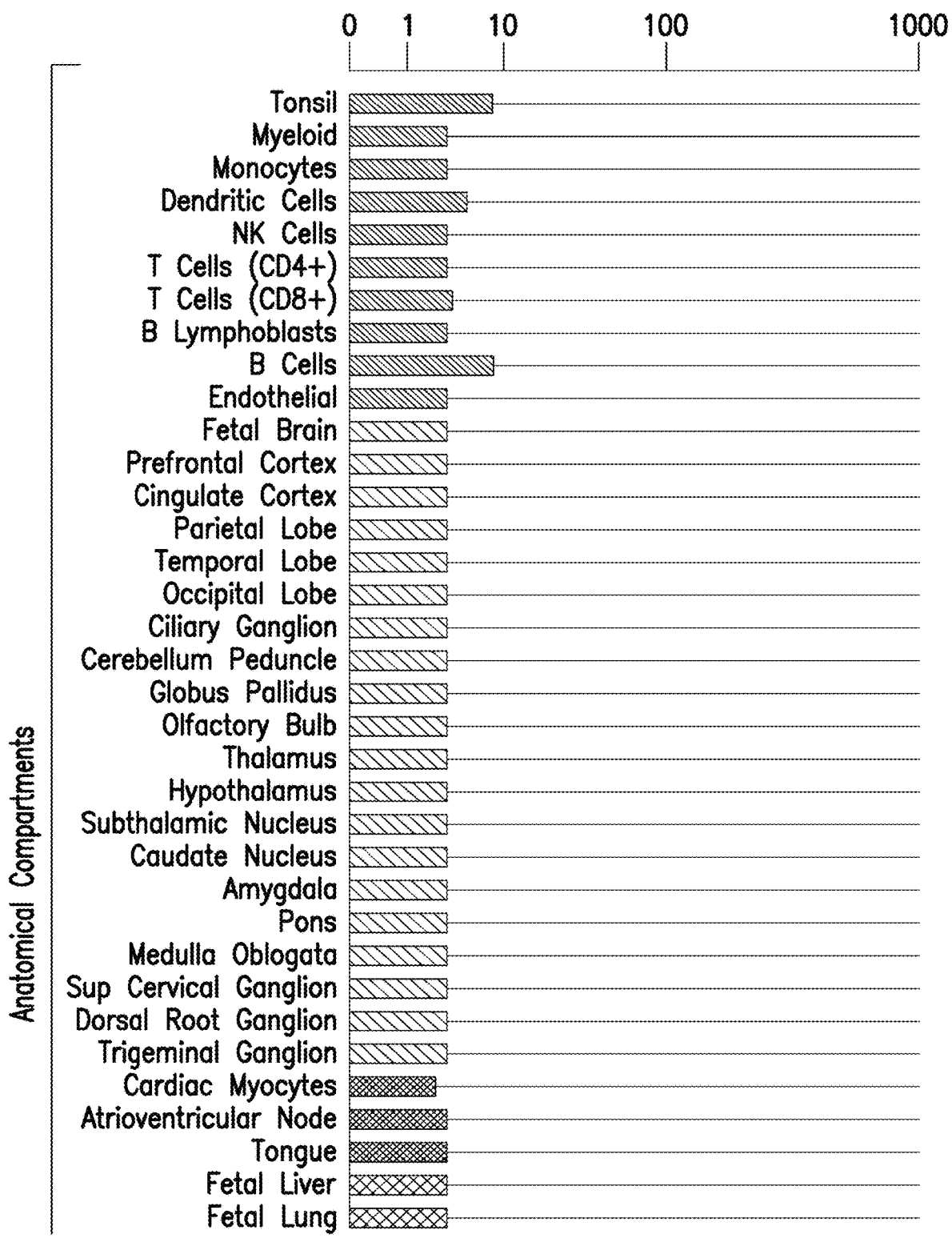
Figure 1:
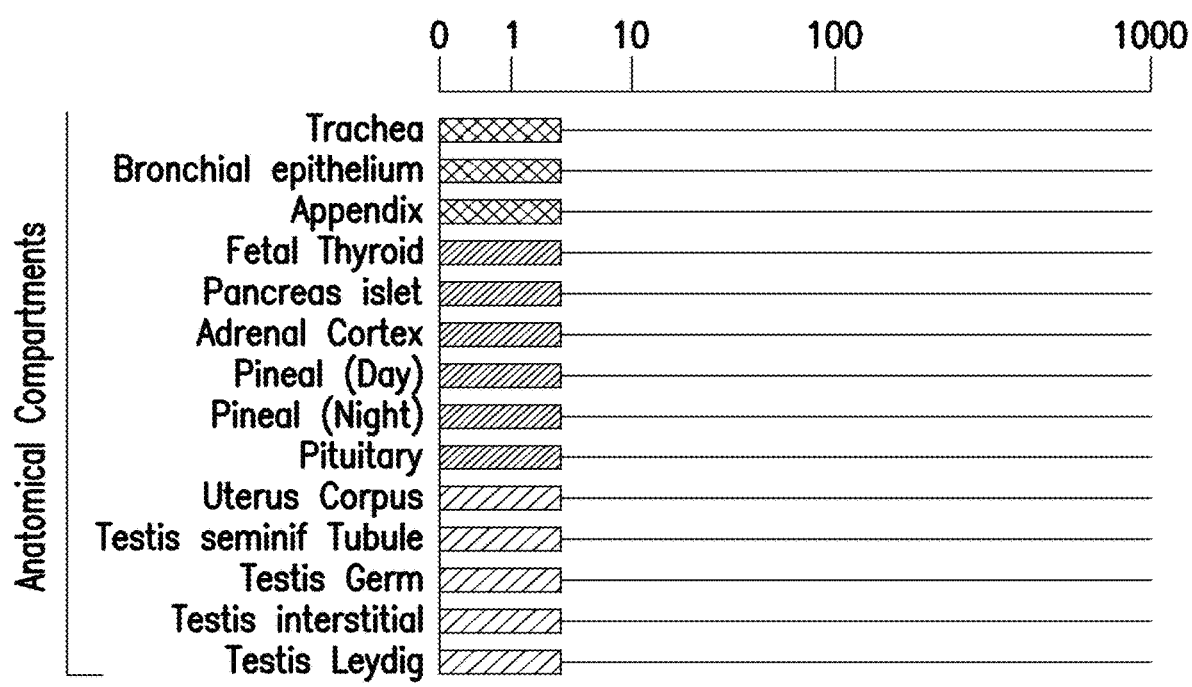

All publications, patents and other references cited herein are incorporated by reference in their entirety into the present disclosure.

In practicing the presently disclosed subject matter, many conventional techniques in molecular biology, microbiology, cell biology, biochemistry, and immunology are used, which are within the skill of the art. These techniques are described in greater detail in, for example, Molecular Cloning: a Laboratory Manual 3rd edition, J. F. Sambrook and D. W. Russell, ed. Cold Spring Harbor Laboratory Press 2001; Recombinant Antibodies for Immunotherapy, Melvyn Little, ed. Cambridge University Press 2009; "Oligonucleotide Synthesis" (M. J. Gait, ed., 1984); "Animal Cell Culture" (R. I. Freshney, ed., 1987); "Methods in Enzymology" (Academic Press, Inc.); "Current Protocols in Molecular Biology" (F. M. Ausubel et al., eds., 1987, and periodic updates); "PCR: The Polymerase Chain Reaction," (Mullis et al., ed., 1994); "A Practical Guide to Molecular Cloning" (Perbal Bernard V., 1988); "Phage Display: A Laboratory Manual" (Barbas et al., 2001). The contents of these references and other references containing standard protocols, widely known to and relied upon by those of skill in the art, including manufacturers' instructions are hereby incorporated by reference as part of the present disclosure.

Definitions

In the description that follows, certain conventions will be followed as regards the usage of terminology. Generally, terms used herein are intended to be interpreted consistently with the meaning of those terms as they are known to those of skill in the art.

An "antigen-binding protein" is a protein or polypeptide that comprises an antigen-binding region or antigen-binding fragment, that is, has a strong affinity to another molecule to which it binds. Antigen-binding proteins encompass antibodies, chimeric antigen receptors (CARs) and fusion proteins.

"Antibody" and "antibodies," as those terms are known in the art, refer to antigen binding-proteins of the immune system. The term "antibody," as referred to herein, includes whole, full length antibodies having an antigen-binding region, and any fragment thereof in which the "antigen-binding portion," "antigen-binding fragment" or "antigen-binding region" is retained, or single chains, for example, single chain variable fragment (scFv), thereof. A naturally occurring "antibody" is a glycoprotein comprising at least two heavy (H) chains and two light (L) chains inter-connected by disulfide bonds. Each heavy chain is comprised of a heavy chain variable region (abbreviated herein as $V_H$) and a heavy chain constant (CH) region. The heavy chain constant region is comprised of three domains, CH1, CH2 and CH3. Each light chain is comprised of a light chain variable region (abbreviated herein as $V_L$) and a light chain constant $C_L$ region. The light chain constant region is comprised of one domain, $C_L$. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (C1 q) of the classical complement system.

The term "human antibody," as used herein, is intended to include antibodies having variable regions in which both the framework and CDR regions are derived from human germline immunoglobulin sequences. Furthermore, if the antibody contains a constant region, the constant region also is derived from human germline immunoglobulin sequences. The human antibodies of the presently disclosed subject matter may include amino acid residues not encoded by human germline immunoglobulin sequences (e.g., mutations introduced by random or site-specific mutagenesis in vitro or by somatic mutation in vivo).

The term "monoclonal antibody," as used herein, refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the presently disclosed subject matter may be made by a variety of techniques, including, but not limited to, the hybridoma method, recombinant DNA methods, phage-display methods, and methods utilizing transgenic animals containing all or part of the human immunoglobulin loci, such methods and other exemplary methods for making monoclonal antibodies being described herein.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom (described further below), (b) antibodies isolated from a host cell transformed to express the human antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies have variable regions in which the framework and CDR regions are derived from human germline immunoglobulin sequences. In certain embodiments, however, such recombinant human antibodies can be subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The term "humanized antibody" is intended to refer to antibodies in which CDR sequences derived from the germline of another mammalian species, such as a mouse, have been grafted onto human framework sequences. Additional framework region modifications may be made within the human framework sequences.

The term "chimeric antibody" is intended to refer to antibodies in which the variable region sequences are derived from one species and the constant region sequences are derived from another species, such as an antibody in which the variable region sequences are derived from a mouse antibody and the constant region sequences are derived from a human antibody.

As used herein, an antibody that "specifically binds to human FcRL5" is intended to refer to an antibody that binds to human FcRL5 with a $K_d$ of $5\times10^{-7}$ M or less, $1\times10^{-7}$ M or less, $5\times10^{-8}$ M or less, $1\times10^{-8}$ M or less, $5\times10^{-9}$ M or less, $1\times10^{-9}$ M or less, $5\times10^{-10}$ M or less, $1\times10^{-10}$ M or less, $5\times10^{-11}$ M or less or $1\times10^{-11}$ M or less.

An "antibody that competes for binding" or "antibody that cross-competes for binding" with a reference antibody for binding to an antigen, e.g., FcRL5, refers to an antibody that blocks binding of the reference antibody to the antigen (e.g., FcRL5) in a competition assay by about 50% or more, e.g., about 55% or more, about 60% or more, about 65% or more, about 70% or more, about 75% or more, about 80% or more, about 85% or more, about 90% or more, about 95% or more, about 98% or more or about 99% or more, and conversely, the reference antibody blocks binding of the antibody to the antigen (e.g., FcRL5) in a competition assay by about 50% or more, e.g., about 55% or more, about 60% or more, about 65% or more, about 70% or more, about 75% or more, about 80% or more, about 85% or more, about 90% or more, about 95% or more, about 98% or more or about 99% or more. An exemplary competition assay is described in "Antibodies," Harlow and Lane (Cold Spring Harbor Press, Cold Spring Harbor, N.Y.)(1988).

As used herein, "isotype" refers to the antibody class (e.g., IgM or IgG1) that is encoded by the heavy chain constant region genes.

The phrases "an antibody recognizing an antigen" and "an antibody specific for an antigen" are used interchangeably herein with the term "an antibody which binds specifically to an antigen" (e.g., a FcRL5 polypeptide).

The term "antigen-binding portion," "antigen-binding fragment" or "antigen-binding region" of an antibody, as used herein, refers to that region or portion of the antibody that binds to the antigen and which confers antigen specificity to the antibody, for example, antibodies includes one or more fragments of an antibody that retain the ability to specifically bind to an antigen (e.g., a FcRL5 polypeptide). It has been shown that the antigen-binding function of an antibody can be performed by fragments of a full-length antibody. Examples of antigen-binding fragments encompassed within the term "antibody fragments" of an antibody include a Fab or Fab' fragment, a monovalent fragment consisting of the $V_L$, $V_H$, $C_L$ and CH1 domains; a F(ab')$_2$ fragment; a F(ab)$_2$ fragment, a bivalent fragment comprising two Fab fragments linked by a disulfide bridge at the hinge region; a Fd fragment consisting of the $V_H$ and CH1 domains; a Fv fragment consisting of the $V_L$ and $V_H$ domains of a single arm of an antibody; a dAb fragment (Ward et al., 1989, Nature 341:544-546), which consists of a $V_H$ domain; and an isolated complementarity determining region (CDR).

Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules. These are known as single chain Fvs (scFvs); see, e.g., Bird et al., 1988 Science 242:423-426; and Huston et al., 1988 Proc. Natl. Acad. Sci. 85:5879-5883. These antibody fragments are obtained using conventional techniques known to those of skill in the art, and the fragments are screened for utility in the same manner as are intact antibodies.

An "isolated antibody" or "isolated antigen-binding fragment" is one which has been identified and separated and/or recovered from a component of its natural environment. "Synthetic antibodies" or "recombinant antibodies" are generally generated using recombinant technology or using peptide synthetic techniques known to those of skill in the art.

The terms "FcRL5" and "FC Receptor-Like 5" are used interchangeably herein, and include variants, isoforms, species homologs of human FcRL5, and analogs having at least one common epitope with FcRL5 (e.g., human FcRL5). Non-limiting examples of human FcRL5 sequences can be found under GenBank Protein Accession Nos: AAI01070.1; XP_011508332.1; XP_011508334.1;) XP_011508333.1; XP_011508332.1; and NP 001182317.1. In certain non-limiting embodiments, FcRL5 is a human FcRL5 having the amino acid sequence set forth in SEQ ID NO:899, or fragments thereof. SEQ ID NO:899 is provided below:

[SEQ ID NO: 899]
MLLWVILLVLAPVSGQFARTPRPIIFLQPPWTTVFQGERVTLTCKGFRFY

SPQKTKWYHRYLGKEILRETPDNILEVQESGEYRCQAQGSPLSSPVHLDF

SSASLILQAPLSVFEGDSVVLRCRAKAEVTLNNTIYKNDNVLAFLNKRTD

FHIPHACLKDNGAYRCTGYKESCCPVSSNTVKIQVQEPFTRPVLRASSFQ

PISGNPVTLTCETQLSLERSDVPLRFRFFRDDQTLGLGWSLSPNFQITAM

WSKDSGFYWCKAATMPHSIISDSPRSWIQVQIPASHPVLTLSPEKALNFE

GTKVTLHCETQEDSLRTLYRFYHEGVPLRHKSVRCERGASISFSLTTENS

GNYYCTADNGLGAKPSKAVSLSVTVPVSHPVLNLSSPEDLIFEGAKVTLH

CEAQRGSLPILYQFHHEDAALERRSANSAGGVAISFSLTAEHSGNYYCTA

DNGFGPQRSKAVSLSITVPVSHPVLTLSSAEALTFEGATVTLHCEVQRGS

PQILYQFYHEDMPLWSSSTPSVGRVSFSFSLTEGHSGNYYCTADNGFGPQ

RSEVVSLFVTVPVSRPILTLRVPRAQAVVGDLLELHCEAPRGSPPILYWF

YHEDVTLGSSSAPSGGEASFNLSLTAEHSGNYSCEANNGLVAQHSDTISL

SVIVPVSRPILTFRAPRAQAVVGDLLELHCEALRGSSPILYWFYHEDVTL

GKISAPSGGGASFNLSLTTEHSGIYSCEADNGLEAQRSEMVTLKVAVPVS

RPVLTLRAPGTHAAVGDLLELHCEALRGSPLILYRFFHEDVTLGNRSSPS

GGASLNLSLTAEHSGNYSCEADNGLGAQRSETVTLYITGLTANRSGPFAT

-continued

GVAGGLLSIAGLAAGALLLYCWLSRKAGRKPASDPARSPSDSDSQEPTYH
NVPAWEELQPVYTNANPRGENVVYSEVRIIQEKKKHAVASDPRHLRNKGS
PIIYSEVKVASTPVSGSLFLASSAPHR.

Figure 3B:
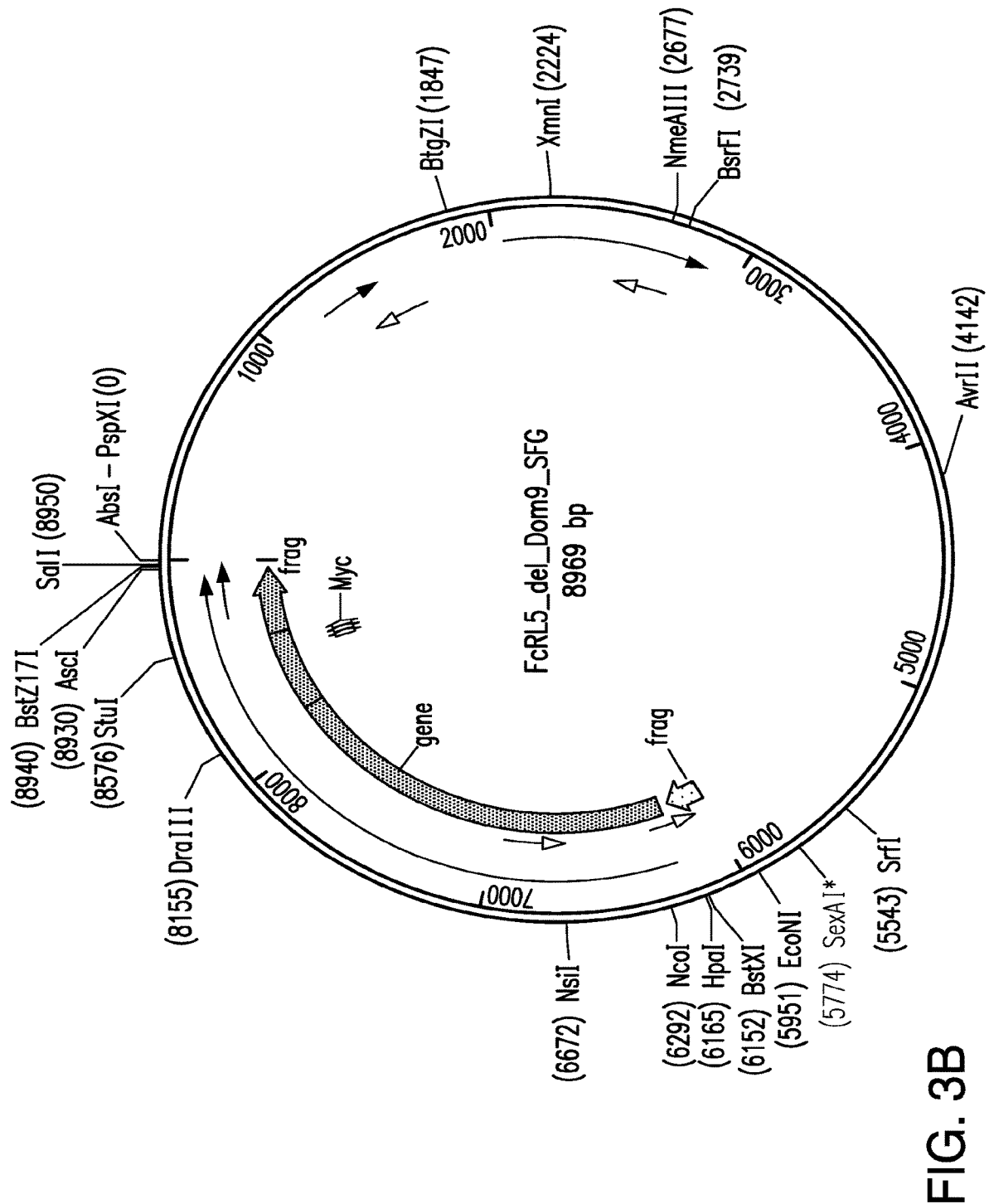
Figure 6:
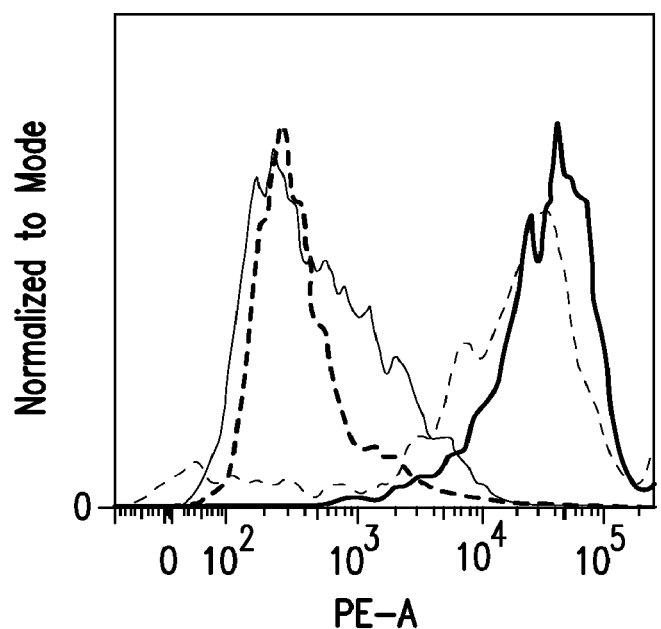
FIG. 6 depicts the screening of anti-FcRL5 scFv ET200-105 on 3T3 cells expressing FcRL5Δdom9.
Figure 7:
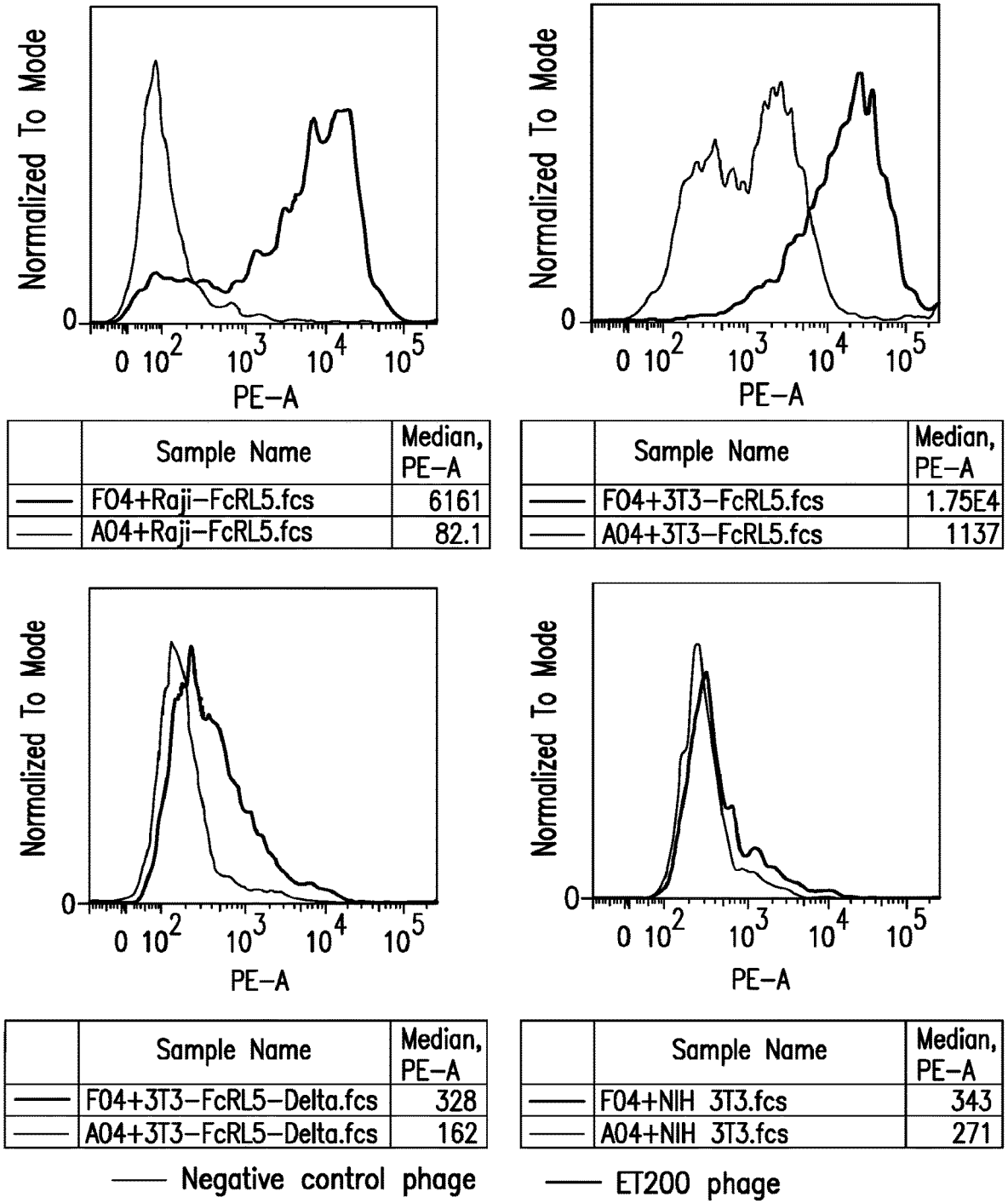
FIG. 7 depicts the screening of anti-FcRL5 scFv ET200-109 on 3T3 cells expressing FcRL5Δdom9.

In certain embodiments, FcRL5 has 9 transmembrane Ig-like domains, i.e., domain 1, domain 2, domain 3, domain 4, domain 5, domain 6, domain 7, domain 8 and domain 9 (see FIGS. 3A and 3B). For example, and not by way of limitation, domain 1 can comprise amino acids 23-100 of SEQ ID NO:899; domain 2 can comprise amino acids 105-185 of SEQ ID NO:899; domain 3 can comprise amino acids 191-273 of SEQ ID NO:899; domain 4 can comprise amino acids 287-373 of SEQ ID NO:899; domain 5 can comprise amino acids 380-466 of SEQ ID NO:899; domain 6 can comprise amino acids 490-555 of SEQ ID NO:899; domain 7 can comprise amino acids 565-638 of SEQ ID NO:899; domain 8 can comprise amino acids 658-731 of SEQ ID NO:899; and domain 9 can comprise amino acids 754-835 of SEQ ID NO:899.

As used herein, the term "single-chain variable fragment" or "scFv" is a fusion protein of the variable regions of the heavy ($V_H$) and light chains ($V_L$) of an immunoglobulin (e.g., mouse or human) covalently linked to form a $V_H$:$V_L$ heterodimer. The heavy ($V_H$) and light chains ($V_L$) are either joined directly or joined by a peptide-encoding linker (e.g., 10, 15, 20, 25 amino acids), which connects the N-terminus of the $V_H$ with the C-terminus of the $V_L$, or the C-terminus of the $V_H$ with the N-terminus of the $V_L$. The linker is usually rich in glycine for flexibility, as well as serine or threonine for solubility. The linker can link the heavy chain variable region and the light chain variable region of the antigen-binding domain. Non-limiting examples of linkers are disclosed in Shen et al., Anal. Chem. 80(6):1910-1917 (2008) and WO 2014/087010, the contents of which are hereby incorporated by reference in their entireties. In certain embodiments, the linker is a G4S linker.

In one non-limiting embodiment, the linker comprises amino acids having the sequence set forth in SEQ ID NO:897 as provided below: GGGGSGGGGSGGGGS [SEQ ID NO: 897]. In one embodiment, the nucleic acid sequence encoding the amino acid sequence of SEQ ID NO:897 is set forth in SEQ ID NO:898, which is provided below:

[SEQ ID NO: 898]
GGTGGAGGTGGATCAGGTGGAGGTGGATCTGGTGGAGGTGGATCT.

In certain embodiments, the linker comprises amino acids having the sequence set forth in SEQ ID NO:307 as provided below: SRGGGGSGGGGSGGGGSLEMA [SEQ ID NO:307]. In certain embodiments, the nucleic acid sequence encoding the amino acid sequence of SEQ ID NO:307 is set forth in SEQ ID NO:305, which is provided below:

[SEQ ID NO: 305]
TCTAGAGGTGGTGGTGGTAGCGGCGGCGGCGGCTCTGGTGGTGGTGGATC
CCTCGAGATGGCC.

In certain embodiments, the linker comprises amino acids having the following sequence GGGGS [SEQ ID NO:901].
In certain embodiments, the linker comprises amino acids having the following sequence SGGSGGS [SEQ ID NO:902].
In certain embodiments, the linker comprises amino acids having the following sequence GGGGSGGGS [SEQ ID NO:903].
In certain embodiments, the linker comprises amino acids having the following sequence GGGGSGGGGS [SEQ ID NO:904].
In certain embodiments, the linker comprises amino acids having the following sequence GGGGSGGGGSGGGGGGGS [SEQ ID NO:905].
In certain embodiments, the linker comprises amino acids having the following sequence GGGGSGGGGSGGGGSGGGGS [SEQ ID NO:906].
In certain embodiments, the linker comprises amino acids having the following sequence GGGGSGGGGSGGGGSGGGGSGGGGS [SEQ ID NO:907].
In certain embodiments, the linker comprises amino acids having the following sequence GGGGSGGGGSGGGGSGGGGSGGGGSGGGGS [ SEQ ID NO:908].
In certain embodiments, the linker comprises amino acids having the following sequence GGGGSGGGGSGGGGSGGGGSGGGGSGGGGSGGGGS [ SEQ ID NO:909].
In certain embodiments, the linker comprises amino acids having the following sequence EPKSCDKTHTCPPCP [SEQ ID NO:910].
In certain embodiments, the linker comprises amino acids having the following sequence GGGGSGGGSEPKSCDKTHTCPPCP [SEQ ID NO:911].
In certain embodiments, the linker comprises amino acids having the following sequence ELKTPLGDTTHTCPRC-PEPKSCDTPPPCPRCPEPKSCDTPPPCPRC-PEPKSCDTPPPCPRCP [SEQ ID NO:912].
In certain embodiments, the linker comprises amino acids having the following sequence GSGSGS [SEQ ID NO:913].
In certain embodiments, the linker comprises amino acids having the following sequence AAA [SEQ ID NO:914].

Despite removal of the constant regions and the introduction of a linker, scFv proteins retain the specificity of the original immunoglobulin. Single chain Fv polypeptide antibodies can be expressed from a nucleic acid comprising $V_H$- and $V_L$-encoding sequences as described by Huston, et al. (Proc. Nat. Acad. Sci. USA, 85:5879-5883, 1988). See, also, U.S. Pat. Nos. 5,091,513, 5,132,405 and 4,956,778; and U.S. Patent Publication Nos. 20050196754 and 20050196754. Antagonistic scFvs having inhibitory activity have been described (see, e.g., Zhao et al., Hybridoma (Larchmt) 2008 27(6):455-51; Peter et al., J Cachexia Sarcopenia Muscle 2012 Aug. 12; Shieh et al., J Immunol 2009 183(4):2277-85; Giomarelli et al., Thromb Haemost 2007 97(6):955-63; Fife et al., J Clin Inst 2006 116(8):2252-61; Brocks et al., Immunotechnology 1997 3(3):173-84; Moosmayer et al., Ther. Immunol. 1995 2(10:31-40). Agonistic scFvs having stimulatory activity have been described (see, e.g., Peter et al., J Bio. Chem. 2003 25278(38):36740-7; Xie et al., Nat Biotech 1997 15(8):768-71; Ledbetter et al., Crit Rev. Immunol. 1997 17(5-6):427-55; Ho et al., BioChim Biophys Acta 2003 1638(3):257-66).

As used herein, "F(ab)" or "Fab" refers to a fragment of an antibody structure that binds to an antigen but is monovalent and does not have a Fc portion, for example, an antibody digested by the enzyme papain yields two F(ab) fragments and an Fc fragment (e.g., a heavy (H) chain constant region; Fc region that does not bind to an antigen).

As used herein, "F(ab')$_2$" refers to an antibody fragment generated by pepsin digestion of whole IgG antibodies, wherein this fragment has two antigen binding (ab') (bivalent) regions, wherein each (ab') region comprises two separate amino acid chains, a part of a H chain and a light (L) chain linked by an S—S bond for binding an antigen and where the remaining H chain portions are linked together. A "F(ab')$_2$" fragment can be split into two individual Fab' fragments.

As used herein, the term "vector" refers to any genetic element, such as a plasmid, phage, transposon, cosmid, chromosome, virus, virion, etc., which is capable of replication when associated with the proper control elements and which can transfer gene sequences into cells. Thus, the term includes cloning and expression vehicles, as well as viral vectors and plasmid vectors.

"CDRs" are defined as the complementarity determining region amino acid sequences of an antibody which are the hypervariable regions of immunoglobulin heavy and light chains. See, e.g., Kabat et al., Sequences of Proteins of Immunological Interest, 4th U.S. Department of Health and Human Services, National Institutes of Health (1987). The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise three heavy chain and three light chain CDRs or CDR regions in the variable region. CDRs provide the majority of contact residues for the binding of the antibody to the antigen or epitope.

An "isolated antibody" is one which has been separated from a component of its natural environment. In certain embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., *J. Chromatogr. B* 848:79-87 (2007).

An "isolated nucleic acid" refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

An "isolated nucleic acid encoding an antibody" (including references to a specific antibody, e.g., an anti-FcRL5 antibody) refers to one or more nucleic acid molecules encoding antibody heavy and light chains (or fragments thereof), including such nucleic acid molecule(s) in a single vector separate vectors, and such nucleic acid molecule(s) present at one or more locations in a host cell.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

An "immunoconjugate" is an antibody conjugated to one or more heterologous molecule(s), including, but not limited to, a cytotoxic agent.

An "effective amount" of an agent, e.g., an anti-FcRL5 antibody or an antigen-binding fragment thereof, refers to an amount effective, at dosages and for periods of time necessary, to achieve the desired therapeutic or prophylactic result, e.g., treating a cancer (or a tumor of the cancer) (e.g., multiple myeloma).

An "individual" or "subject" is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the individual or subject is a human.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In certain embodiments, antibodies of the presently disclosed subject matter are used to delay development of a disease or to slow the progression of a disease, e.g., a tumor (multiple myeloma).

As used herein, the term "about" or "approximately" means within an acceptable error range for the particular value as determined by one of ordinary skill in the art, which will depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

As described herein, any concentration range, percentage range, ratio range or integer range is to be understood to include the value of any integer within the recited range and, when appropriate, fractions thereof (such as one tenth and one hundredth of an integer), unless otherwise indicated.

Anti-FcRL5 Antibodies

The presently disclosed subject matter provides fully human antibodies or antigen binding fragments that are specific to FcRL5. The anti-FcRL5 antibodies or antigen binding fragments thereof of the present disclosure are based on the identification and selection of single chain variable fragments (scFvs) using phage display, the amino acid sequences of which confer the molecules' specificity for a FcRL5 polypeptide of interest and forms the basis of all FcRL5 antibodies or antigen binding fragments thereof of the disclosure. The scFvs, therefore, can be used to design a diverse array of "antibody" molecules, including, for example, full length antibodies, fragments thereof, such as Fab, Fab' and F(ab')$_2$, minibodies, fusion proteins, including scFv-Fc fusions, multivalent antibodies, that is, antibodies that have more than one specificity for the same antigen or different antigens, for example, bispecific antibodies, tribodies, etc. (see Cuesta et al., Multivalent antibodies: when design surpasses evolution. Trends in Biotechnology 28:355-362 2010).

The antibodies of the presently disclosed subject matter are characterized by particular functional features or properties of the antibodies. For example, the antibodies of the present disclosure bind specifically to FcRL5 (e.g., bind to human FcRL5 and may cross-react with FcRL5 from other species, such as mouse) with high affinity. In certain embodiments, antibodies of the present disclosure can bind to at least a portion of an FcRL5 polypeptide comprising the amino acid sequence set forth in SEQ ID NO:899 with high affinity. In certain embodiments, an antibody or antigen-binding fragment thereof of the present disclosure binds to at least a portion of the domain 8 of FcRL5 with high affinity. In certain embodiments, an antibody or antigen-binding fragment thereof of the present disclosure binds to at least a portion of the domain 7 of FcRL5 with high affinity. In certain embodiments, an antibody or antigen-binding fragment thereof of the present disclosure binds to at least a portion of the domain 8 of FcRL5 with high affinity. In certain embodiments, an antibody or antigen-binding fragment thereof of the present disclosure specifically binds to domain 9 of FcRL5 with high affinity. For example, and not by way of limitation, domain 9 of FcRL5 can have the amino acid sequence set forth in SEQ ID NO:900, or fragments thereof. SEQ ID NO:900 is provided below: RPVLTLRAPGTHAAVGDL-LELHCEALRGSPLILYRFFHEDVTLGNRSSPSG-GASLNLSLTAE HSGNYSCEADNGLGAQRSETVTLYI [SEQ ID NO:900]. In certain embodiments, domain 9 of FcRL5 can have the amino acid sequence set forth in SEQ ID NO:917, or fragments thereof. SEQ ID NO:917 is provided below:

[SEQ ID NO: 917]
GTHAAVGDLLELHCEALRGSPLILYRFFHEDVTLGNRSSPSGGASLNLSL

TAEHSGNYSCEADNGLGAQRSETVTLYI.

In certain embodiments, domain 9 of FcRL5 comprises an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence of SEQ ID NO:900 or 917. In certain embodiments, an antibody of the presently disclosed subject matter binds to FcRL5 or a portion thereof, e.g., domain 9 of FcRL5, with a $K_d$ of $1\times10^{-7}$ M or less, e.g., about $1\times10^{-8}$ M or less, about $1\times10^{-9}$ M or less, about $1\times10^{-10}$ M or less or about $1\times10^{-11}$ M or less. In certain embodiments, a presently disclosed anti-FcRL5 antibody binds to FcRL5 (e.g., human FcRL5) with a $K_d$ of from about $1\times10^{-11}$ M to about $1\times10^{-7}$ M, e.g., from about $1\times10^{-11}$ M to about $1\times10^{-10}$ M, from about $1\times10^{-10}$ M to about $1\times10^{-9}$ M, from $1\times10^{-9}$ M to about $1\times10^{-8}$ M, or from about $1\times10^{-8}$ M to about $1\times10^{-7}$ M.

The heavy and light chains of an anti-FcRL5 antibody of the present disclosure can be full-length (e.g., an antibody including at least one (e.g., one or two) complete heavy chains, and at least one (e.g., one or two) complete light chains) or can include an antigen-binding portion (e.g., a Fab, Fab', F(ab')$_2$, Fv or a single chain Fv fragment ("scFv")). In certain embodiments, an anti-FcRL5 antibody of the present disclosure can include a one or more constant regions. In certain embodiments, the heavy chain constant region of a disclosed antibody is chosen from, e.g., IgG1, IgG2, IgG3, IgG4, IgM, IgA1, IgA2, IgD, and IgE. In certain embodiments, the immunoglobulin isotype is selected from IgG1, IgG2, IgG3, and IgG4, more particularly, IgG1 (e.g., human IgG1). In another non-limiting embodiment, the antibody light chain constant region is chosen from, e.g., kappa or lambda, particularly kappa. The choice of antibody isotype can depend on the immune effector function that the antibody is designed to elicit. In constructing a recombinant immunoglobulin, appropriate amino acid sequences for constant regions of various immunoglobulin isotypes and methods for the production of a wide array of antibodies are known to those of skill in the art.

1. Single-Chain Variable Fragments (scFvs)

In certain embodiments, the presently disclosed subject matter includes antibodies that have the scFv sequence fused to one or more constant domains to form an antibody with an Fc region of a human immunoglobulin to yield a bivalent protein, increasing the overall avidity and stability of the antibody. In addition, the Fc portion allows the direct conjugation of other molecules, including, but not limited to, fluorescent dyes, cytotoxins, radioisotopes etc. to the antibody for example, for use in antigen quantitation studies, to immobilize the antibody for affinity measurements, for targeted delivery of a therapeutic agent, to test for Fc-mediated cytotoxicity using immune effector cells and many other applications.

The presently disclosure subject matter provides scFvs that specifically bind to an FcRL5 polypeptide. In certain embodiments, an anti-FcRL5 scFv antibody of the present disclosure comprises a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303, wherein the scFv antibody binds to an FcRL5 polypeptide.

In certain embodiments, an anti-FcRL5 scFv antibody of the present disclosure comprises a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, wherein the scFv antibody binds to an FcRL5 polypeptide.

In certain embodiments, an anti-FcRL5 scFv antibody comprises (a) a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303 and (b) a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, wherein the scFv antibody binds to an FcRL5 polypeptide.

In certain embodiments, the anti-FcRL5 scFv antibody, optionally comprises (c) a linker sequence, for example a linker peptide, between the heavy chain variable region and the light chain variable region. In one non-limiting embodiment, the linker comprises amino acids having the sequence set forth in SEQ ID NO:307. In certain embodiments, the linker comprises the amino acid sequence set forth in SEQ ID NO:897.

In certain embodiments, an anti-FcRL5 scFv antibody comprises (a) a light chain variable region comprising amino acids having a sequence set forth in SEQ ID NO:3, and (b) a heavy chain variable region comprising amino acids having a sequence set forth in SEQ ID NO:4.

In certain embodiments, an anti-FcRL5 scFv antibody comprises (a) a light chain variable region comprising amino acids having a sequence set forth in SEQ ID NO:7, and (b) a heavy chain variable region comprising amino acids having a sequence set forth in SEQ ID NO:8.

In certain embodiments, an anti-FcRL5 scFv antibody comprises (a) a light chain variable region comprising amino acids having a sequence set forth in SEQ ID NO:11, and (b) a heavy chain variable region comprising amino acids having a sequence set forth in SEQ ID NO:12.

In certain embodiments, an anti-FcRL5 scFv antibody comprises (a) a light chain variable region comprising amino acids having a sequence set forth in SEQ ID NO:15, and (b) a heavy chain variable region comprising amino acids having a sequence set forth in SEQ ID NO:16.

In certain embodiments, an anti-FcRL5 scFv antibody comprises (a) a light chain variable region comprising amino acids having a sequence set forth in SEQ ID NO:19, and (b) a heavy chain variable region comprising amino acids having a sequence set forth in SEQ ID NO:20.

In certain embodiments, an anti-FcRL5 scFv antibody comprises (a) a light chain variable region comprising amino acids having a sequence set forth in SEQ ID NO:23, and (b) a heavy chain variable region comprising amino acids having a sequence set forth in SEQ ID NO:24.

In certain embodiments, an anti-FcRL5 scFv antibody comprises (a) a light chain variable region comprising amino acids having a sequence set forth in SEQ ID NO:27, and (b) a heavy chain variable region comprising amino acids having a sequence set forth in SEQ ID NO:28.

In certain embodiments, an anti-FcRL5 scFv antibody comprises (a) a light chain variable region comprising amino acids having a sequence set forth in SEQ ID NO:31, and (b) a heavy chain variable region comprising amino acids having a sequence set forth in SEQ ID NO:32.

In certain embodiments, an anti-FcRL5 scFv antibody comprises (a) a light chain variable region comprising amino acids having a sequence set forth in SEQ ID NO:35, and (b) a heavy chain variable region comprising amino acids having a sequence set forth in SEQ ID NO:36.

In certain embodiments, an anti-FcRL5 scFv antibody comprises (a) a light chain variable region comprising amino acids having a sequence set forth in SEQ ID NO:39, and (b) a heavy chain variable region comprising amino acids having a sequence set forth in SEQ ID NO:40.

In certain embodiments, an anti-FcRL5 scFv antibody comprises (a) a light chain variable region comprising amino acids having a sequence set forth in SEQ ID NO:43, and (b) a heavy chain variable region comprising amino acids having a sequence set forth in SEQ ID NO:44.

In certain embodiments, an anti-FcRL5 scFv antibody comprises (a) a light chain variable region comprising amino acids having a sequence set forth in SEQ ID NO:47, and (b) a heavy chain variable region comprising amino acids having a sequence set forth in SEQ ID NO:48.

In certain embodiments, an anti-FcRL5 scFv antibody comprises (a) a light chain variable region comprising amino acids having a sequence set forth in SEQ ID NO:51, and (b) a heavy chain variable region comprising amino acids having a sequence set forth in SEQ ID NO:52.

In certain embodiments, an anti-FcRL5 scFv antibody comprises (a) a light chain variable region comprising amino acids having a sequence set forth in SEQ ID NO:55, and (b) a heavy chain variable region comprising amino acids having a sequence set forth in SEQ ID NO:56.

In certain embodiments, an anti-FcRL5 scFv antibody comprises (a) a light chain variable region comprising amino acids having a sequence set forth in SEQ ID NO:59, and (b) a heavy chain variable region comprising amino acids having a sequence set forth in SEQ ID NO:60.

In certain embodiments, an anti-FcRL5 scFv antibody comprises (a) a light chain variable region comprising amino acids having a sequence set forth in SEQ ID NO:63, and (b) a heavy chain variable region comprising amino acids having a sequence set forth in SEQ ID NO:64.

In certain embodiments, an anti-FcRL5 scFv antibody comprises (a) a light chain variable region comprising amino acids having a sequence set forth in SEQ ID NO:67, and (b) a heavy chain variable region comprising amino acids having a sequence set forth in SEQ ID NO:68.

In certain embodiments, an anti-FcRL5 scFv antibody comprises (a) a light chain variable region comprising amino acids having a sequence set forth in SEQ ID NO:71, and (b) a heavy chain variable region comprising amino acids having a sequence set forth in SEQ ID NO:72.

In certain embodiments, an anti-FcRL5 scFv antibody comprises (a) a light chain variable region comprising amino acids having a sequence set forth in SEQ ID NO:75, and (b) a heavy chain variable region comprising amino acids having a sequence set forth in SEQ ID NO:76.

In certain embodiments, an anti-FcRL5 scFv antibody comprises (a) a light chain variable region comprising amino acids having a sequence set forth in SEQ ID NO:79, and (b) a heavy chain variable region comprising amino acids having a sequence set forth in SEQ ID NO:80.

In certain embodiments, an anti-FcRL5 scFv antibody comprises (a) a light chain variable region comprising amino acids having a sequence set forth in SEQ ID NO:83, and (b) a heavy chain variable region comprising amino acids having a sequence set forth in SEQ ID NO:84.

In certain embodiments, an anti-FcRL5 scFv antibody comprises (a) a light chain variable region comprising amino acids having a sequence set forth in SEQ ID NO:87, and (b) a heavy chain variable region comprising amino acids having a sequence set forth in SEQ ID NO:88.

In certain embodiments, an anti-FcRL5 scFv antibody comprises (a) a light chain variable region comprising amino acids having a sequence set forth in SEQ ID NO:91, and (b) a heavy chain variable region comprising amino acids having a sequence set forth in SEQ ID NO:92.

In certain embodiments, an anti-FcRL5 scFv antibody comprises (a) a light chain variable region comprising amino acids having a sequence set forth in SEQ ID NO:95, and (b) a heavy chain variable region comprising amino acids having a sequence set forth in SEQ ID NO:96.

In certain embodiments, an anti-FcRL5 scFv antibody comprises (a) a light chain variable region comprising amino acids having a sequence set forth in SEQ ID NO:99, and (b) a heavy chain variable region comprising amino acids having a sequence set forth in SEQ ID NO:100.

In certain embodiments, an anti-FcRL5 scFv antibody comprises (a) a light chain variable region comprising amino acids having a sequence set forth in SEQ ID NO:103, and (b) a heavy chain variable region comprising amino acids having a sequence set forth in SEQ ID NO:104.

In certain embodiments, an anti-FcRL5 scFv antibody comprises (a) a light chain variable region comprising amino acids having a sequence set forth in SEQ ID NO:107, and (b) a heavy chain variable region comprising amino acids having a sequence set forth in SEQ ID NO:108.

In certain embodiments, an anti-FcRL5 scFv antibody comprises (a) a light chain variable region comprising amino acids having a sequence set forth in SEQ ID NO:111, and (b) a heavy chain variable region comprising amino acids having a sequence set forth in SEQ ID NO:112.

In certain embodiments, an anti-FcRL5 scFv antibody comprises (a) a light chain variable region comprising amino acids having a sequence set forth in SEQ ID NO:115, and (b) a heavy chain variable region comprising amino acids having a sequence set forth in SEQ ID NO:116.

In certain embodiments, an anti-FcRL5 scFv antibody comprises (a) a light chain variable region comprising amino acids having a sequence set forth in SEQ ID NO:119, and (b) a heavy chain variable region comprising amino acids having a sequence set forth in SEQ ID NO:120.

In certain embodiments, an anti-FcRL5 scFv antibody comprises (a) a light chain variable region comprising amino acids having a sequence set forth in SEQ ID NO:123, and (b) a heavy chain variable region comprising amino acids having a sequence set forth in SEQ ID NO:124.

In certain embodiments, an anti-FcRL5 scFv antibody comprises (a) a light chain variable region comprising amino acids having a sequence set forth in SEQ ID NO:127, and (b) a heavy chain variable region comprising amino acids having a sequence set forth in SEQ ID NO:128.

In certain embodiments, an anti-FcRL5 scFv antibody comprises (a) a light chain variable region comprising amino acids having a sequence set forth in SEQ ID NO:131, and (b) a heavy chain variable region comprising amino acids having a sequence set forth in SEQ ID NO:132.

In certain embodiments, an anti-FcRL5 scFv antibody comprises (a) a light chain variable region comprising amino acids having a sequence set forth in SEQ ID NO:135, and (b) a heavy chain variable region comprising amino acids having a sequence set forth in SEQ ID NO:136.

In certain embodiments, an anti-FcRL5 scFv antibody comprises (a) a light chain variable region comprising amino acids having a sequence set forth in SEQ ID NO:139, and (b) a heavy chain variable region comprising amino acids having a sequence set forth in SEQ ID NO:140.

In certain embodiments, an anti-FcRL5 scFv antibody comprises (a) a light chain variable region comprising amino acids having a sequence set forth in SEQ ID NO:143, and (b) a heavy chain variable region comprising amino acids having a sequence set forth in SEQ ID NO:144.

In certain embodiments, an anti-FcRL5 scFv antibody comprises (a) a light chain variable region comprising amino acids having a sequence set forth in SEQ ID NO:147, and (b) a heavy chain variable region comprising amino acids having a sequence set forth in SEQ ID NO:148.

In certain embodiments, an anti-FcRL5 scFv antibody comprises (a) a light chain variable region comprising amino acids having a sequence set forth in SEQ ID NO:151, and (b) a heavy chain variable region comprising amino acids having a sequence set forth in SEQ ID NO:152.

In certain embodiments, an anti-FcRL5 scFv antibody comprises (a) a light chain variable region comprising amino acids having a sequence set forth in SEQ ID NO:155, and (b)

a heavy chain variable region comprising amino acids having a sequence set forth in SEQ ID NO:156.

In certain embodiments, an anti-FcRL5 scFv antibody comprises (a) a light chain variable region comprising amino acids having a sequence set forth in SEQ ID NO:159, and (b) a heavy chain variable region comprising amino acids having a sequence set forth in SEQ ID NO:160.

In certain embodiments, an anti-FcRL5 scFv antibody comprises (a) a light chain variable region comprising amino acids having a sequence set forth in SEQ ID NO:163, and (b) a heavy chain variable region comprising amino acids having a sequence set forth in SEQ ID NO:164.

In certain embodiments, an anti-FcRL5 scFv antibody comprises (a) a light chain variable region comprising amino acids having a sequence set forth in SEQ ID NO:167, and (b) a heavy chain variable region comprising amino acids having a sequence set forth in SEQ ID NO:168.

In certain embodiments, an anti-FcRL5 scFv antibody comprises (a) a light chain variable region comprising amino acids having a sequence set forth in SEQ ID NO:171, and (b) a heavy chain variable region comprising amino acids having a sequence set forth in SEQ ID NO:172.

In certain embodiments, an anti-FcRL5 scFv antibody comprises (a) a light chain variable region comprising amino acids having a sequence set forth in SEQ ID NO:175, and (b) a heavy chain variable region comprising amino acids having a sequence set forth in SEQ ID NO:176.

In certain embodiments, an anti-FcRL5 scFv antibody comprises (a) a light chain variable region comprising amino acids having a sequence set forth in SEQ ID NO:179, and (b) a heavy chain variable region comprising amino acids having a sequence set forth in SEQ ID NO:180.

In certain embodiments, an anti-FcRL5 scFv antibody comprises (a) a light chain variable region comprising amino acids having a sequence set forth in SEQ ID NO:183, and (b) a heavy chain variable region comprising amino acids having a sequence set forth in SEQ ID NO:184.

In certain embodiments, an anti-FcRL5 scFv antibody comprises (a) a light chain variable region comprising amino acids having a sequence set forth in SEQ ID NO:187, and (b) a heavy chain variable region comprising amino acids having a sequence set forth in SEQ ID NO:188.

In certain embodiments, an anti-FcRL5 scFv antibody comprises (a) a light chain variable region comprising amino acids having a sequence set forth in SEQ ID NO:191, and (b) a heavy chain variable region comprising amino acids having a sequence set forth in SEQ ID NO:192.

In certain embodiments, an anti-FcRL5 scFv antibody comprises (a) a light chain variable region comprising amino acids having a sequence set forth in SEQ ID NO:195, and (b) a heavy chain variable region comprising amino acids having a sequence set forth in SEQ ID NO:196.

In certain embodiments, an anti-FcRL5 scFv antibody comprises (a) a light chain variable region comprising amino acids having a sequence set forth in SEQ ID NO:199, and (b) a heavy chain variable region comprising amino acids having a sequence set forth in SEQ ID NO:200.

In certain embodiments, an anti-FcRL5 scFv antibody comprises (a) a light chain variable region comprising amino acids having a sequence set forth in SEQ ID NO:203, and (b) a heavy chain variable region comprising amino acids having a sequence set forth in SEQ ID NO:204.

In certain embodiments, an anti-FcRL5 scFv antibody comprises (a) a light chain variable region comprising amino acids having a sequence set forth in SEQ ID NO:207, and (b) a heavy chain variable region comprising amino acids having a sequence set forth in SEQ ID NO:208.

In certain embodiments, an anti-FcRL5 scFv antibody comprises (a) a light chain variable region comprising amino acids having a sequence set forth in SEQ ID NO:211, and (b) a heavy chain variable region comprising amino acids having a sequence set forth in SEQ ID NO:212.

In certain embodiments, an anti-FcRL5 scFv antibody comprises (a) a light chain variable region comprising amino acids having a sequence set forth in SEQ ID NO:215, and (b) a heavy chain variable region comprising amino acids having a sequence set forth in SEQ ID NO:216.

In certain embodiments, an anti-FcRL5 scFv antibody comprises (a) a light chain variable region comprising amino acids having a sequence set forth in SEQ ID NO:219, and (b) a heavy chain variable region comprising amino acids having a sequence set forth in SEQ ID NO:220.

In certain embodiments, an anti-FcRL5 scFv antibody comprises (a) a light chain variable region comprising amino acids having a sequence set forth in SEQ ID NO:223, and (b) a heavy chain variable region comprising amino acids having a sequence set forth in SEQ ID NO:224.

In certain embodiments, an anti-FcRL5 scFv antibody comprises (a) a light chain variable region comprising amino acids having a sequence set forth in SEQ ID NO:227, and (b) a heavy chain variable region comprising amino acids having a sequence set forth in SEQ ID NO:228.

In certain embodiments, an anti-FcRL5 scFv antibody comprises (a) a light chain variable region comprising amino acids having a sequence set forth in SEQ ID NO:231, and (b) a heavy chain variable region comprising amino acids having a sequence set forth in SEQ ID NO:232.

In certain embodiments, an anti-FcRL5 scFv antibody comprises (a) a light chain variable region comprising amino acids having a sequence set forth in SEQ ID NO:235, and (b) a heavy chain variable region comprising amino acids having a sequence set forth in SEQ ID NO:236.

In certain embodiments, an anti-FcRL5 scFv antibody comprises (a) a light chain variable region comprising amino acids having a sequence set forth in SEQ ID NO:239, and (b) a heavy chain variable region comprising amino acids having a sequence set forth in SEQ ID NO:240.

In certain embodiments, an anti-FcRL5 scFv antibody comprises (a) a light chain variable region comprising amino acids having a sequence set forth in SEQ ID NO:243, and (b) a heavy chain variable region comprising amino acids having a sequence set forth in SEQ ID NO:244.

In certain embodiments, an anti-FcRL5 scFv antibody comprises (a) a light chain variable region comprising amino acids having a sequence set forth in SEQ ID NO:247, and (b) a heavy chain variable region comprising amino acids having a sequence set forth in SEQ ID NO:248.

In certain embodiments, an anti-FcRL5 scFv antibody comprises (a) a light chain variable region comprising amino acids having a sequence set forth in SEQ ID NO:251, and (b) a heavy chain variable region comprising amino acids having a sequence set forth in SEQ ID NO:252.

In certain embodiments, an anti-FcRL5 scFv antibody comprises (a) a light chain variable region comprising amino acids having a sequence set forth in SEQ ID NO:255, and (b) a heavy chain variable region comprising amino acids having a sequence set forth in SEQ ID NO:256.

In certain embodiments, an anti-FcRL5 scFv antibody comprises (a) a light chain variable region comprising amino acids having a sequence set forth in SEQ ID NO:259, and (b) a heavy chain variable region comprising amino acids having a sequence set forth in SEQ ID NO:260.

In certain embodiments, an anti-FcRL5 scFv antibody comprises (a) a light chain variable region comprising amino acids having a sequence set forth in SEQ ID NO:263, and (b) a heavy chain variable region comprising amino acids having a sequence set forth in SEQ ID NO:264.

In certain embodiments, an anti-FcRL5 scFv antibody comprises (a) a light chain variable region comprising amino acids having a sequence set forth in SEQ ID NO:267, and (b) a heavy chain variable region comprising amino acids having a sequence set forth in SEQ ID NO:268.

In certain embodiments, an anti-FcRL5 scFv antibody comprises (a) a light chain variable region comprising amino acids having a sequence set forth in SEQ ID NO:271, and (b) a heavy chain variable region comprising amino acids having a sequence set forth in SEQ ID NO:272.

In certain embodiments, an anti-FcRL5 scFv antibody comprises (a) a light chain variable region comprising amino acids having a sequence set forth in SEQ ID NO:275, and (b) a heavy chain variable region comprising amino acids having a sequence set forth in SEQ ID NO:276.

In certain embodiments, an anti-FcRL5 scFv antibody comprises (a) a light chain variable region comprising amino acids having a sequence set forth in SEQ ID NO:279, and (b) a heavy chain variable region comprising amino acids having a sequence set forth in SEQ ID NO:280.

In certain embodiments, an anti-FcRL5 scFv antibody comprises (a) a light chain variable region comprising amino acids having a sequence set forth in SEQ ID NO:283, and (b) a heavy chain variable region comprising amino acids having a sequence set forth in SEQ ID NO:284.

In certain embodiments, an anti-FcRL5 scFv antibody comprises (a) a light chain variable region comprising amino acids having a sequence set forth in SEQ ID NO:287, and (b) a heavy chain variable region comprising amino acids having a sequence set forth in SEQ ID NO:288.

In certain embodiments, an anti-FcRL5 scFv antibody comprises (a) a light chain variable region comprising amino acids having a sequence set forth in SEQ ID NO:291, and (b) a heavy chain variable region comprising amino acids having a sequence set forth in SEQ ID NO:292.

In certain embodiments, an anti-FcRL5 scFv antibody comprises (a) a light chain variable region comprising amino acids having a sequence set forth in SEQ ID NO:279, and (b) a heavy chain variable region comprising amino acids having a sequence set forth in SEQ ID NO:280.

In certain embodiments, an anti-FcRL5 scFv antibody comprises (a) a light chain variable region comprising amino acids having a sequence set forth in SEQ ID NO:283, and (b) a heavy chain variable region comprising amino acids having a sequence set forth in SEQ ID NO:284.

In certain embodiments, an anti-FcRL5 scFv antibody comprises (a) a light chain variable region comprising amino acids having a sequence set forth in SEQ ID NO:287, and (b) a heavy chain variable region comprising amino acids having a sequence set forth in SEQ ID NO:288.

In certain embodiments, an anti-FcRL5 scFv antibody comprises (a) a light chain variable region comprising amino acids having a sequence set forth in SEQ ID NO:291, and (b) a heavy chain variable region comprising amino acids having a sequence set forth in SEQ ID NO:292.

In certain embodiments, an anti-FcRL5 scFv antibody comprises (a) a light chain variable region comprising amino acids having a sequence set forth in SEQ ID NO:295, and (b) a heavy chain variable region comprising amino acids having a sequence set forth in SEQ ID NO:296.

In certain embodiments, an anti-FcRL5 scFv antibody comprises (a) a light chain variable region comprising amino acids having a sequence set forth in SEQ ID NO:299, and (b) a heavy chain variable region comprising amino acids having a sequence set forth in SEQ ID NO:300.

In certain embodiments, an anti-FcRL5 scFv antibody comprises (a) a light chain variable region comprising amino acids having a sequence set forth in SEQ ID NO:303, and (b) a heavy chain variable region comprising amino acids having a sequence set forth in SEQ ID NO:304.

The presently disclosed subject matter further provides anti-FcRL5 scFv antibodies that comprise heavy chain variable region and light chain variable region CDRs, e.g., CDR1s, CDR2s and CDR3s, as disclosed herein in Table 229. The CDR regions are delineated using the Kabat system (Kabat, E. A., et al. (1991) Sequences of Proteins of Immunological Interest, Fifth Edition, U. S. Department of Health and Human Services, NIH Publication No. 91-3242).

In certain embodiments, an anti-FcRL5 scFv antibody comprises a light chain variable region, wherein the light chain variable region comprises: (a) a CDR1 comprising an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585 and 588; (b) a CDR2 comprising an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575 and 586; and (c) a CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592; wherein the antibody specifically binds FcRL5.

In certain embodiments, an anti-FcRL5 scFv antibody comprises a heavy chain variable region, wherein the heavy chain variable region comprises: (a) a CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582 and 589; (b) a CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583 and 590; and (c) a CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591; wherein the anti-FcRL5 scFv antibody specifically binds FcRL5.

In certain embodiments, the presently disclosed subject matter provides an anti-FcRL5 scFv antibody comprising: (a) a heavy chain variable region CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591; and (b) a light chain variable region CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592; wherein the anti-FcRL5 scFv antibody specifically binds FcRL5.

In certain embodiments, an anti-FcRL5 scFv antibody of the present disclosure comprises a heavy chain variable region CDR1, a heavy chain variable region CDR2, a heavy chain variable region CDR3, a light chain variable region CDR1, a light chain variable region CDR2 and a light chain variable region CDR3 selected from Table 229. For example, and not by way of limitation, an anti-FcRL5 scFv antibody comprises: (a) a heavy chain variable region CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582 and 589; (b) a heavy chain variable region CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583 and 590; (c) a heavy chain variable region CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591; (d) a light chain variable region CDR1 comprising an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585 and 588; (e) a light chain variable region CDR2 comprising an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575 and 586; and (f) a light chain variable region CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592; wherein the antibody specifically binds FcRL5.

In certain embodiments, an anti-FcRL5 scFv antibody comprises: (a) a heavy chain variable region CDR1 comprising the amino acid sequence of SEQ ID NO:411; (b) a heavy chain variable region CDR2 comprising the amino acid sequence of SEQ ID NO:412; (c) a heavy chain variable region CDR3 comprising the amino acid sequence of SEQ ID NO:463; (d) a light chain variable region CDR1 comprising the amino acid sequence of SEQ ID NO:318; (e) a light chain variable region CDR2 comprising the amino acid sequence of SEQ ID NO:319; and (f) a light chain variable region CDR3 comprising the amino acid sequence of SEQ ID NO:419.

In certain embodiments, an anti-FcRL5 scFv antibody comprises: (a) a heavy chain variable region CDR1 comprising the amino acid sequence of SEQ ID NO:515; (b) a heavy chain variable region CDR2 comprising the amino acid sequence of SEQ ID NO:516; (c) a heavy chain variable region CDR3 comprising the amino acid sequence of SEQ ID NO:517; (d) a light chain variable region CDR1 comprising the amino acid sequence of SEQ ID NO:318; (e) a light chain variable region CDR2 comprising the amino acid sequence of SEQ ID NO:319; and (f) a light chain variable region CDR3 comprising the amino acid sequence of SEQ ID NO:531.

In certain embodiments, an anti-FcRL5 scFv antibody comprises: (a) a heavy chain variable region CDR1 comprising the amino acid sequence of SEQ ID NO:403; (b) a heavy chain variable region CDR2 comprising the amino acid sequence of SEQ ID NO:404; (c) a heavy chain variable region CDR3 comprising the amino acid sequence of SEQ ID NO:532; (d) a light chain variable region CDR1 comprising the amino acid sequence of SEQ ID NO:533; (e) a light chain variable region CDR2 comprising the amino acid sequence of SEQ ID NO:534; and (f) a light chain variable region CDR3 comprising the amino acid sequence of SEQ ID NO:535.

In certain embodiments, an anti-FcRL5 scFv antibody comprises: (a) a heavy chain variable region CDR1 comprising the amino acid sequence of SEQ ID NO:411; (b) a heavy chain variable region CDR2 comprising the amino acid sequence of SEQ ID NO:412; (c) a heavy chain variable region CDR3 comprising the amino acid sequence of SEQ ID NO:543; (d) a light chain variable region CDR1 comprising the amino acid sequence of SEQ ID NO:544; (e) a light chain variable region CDR2 comprising the amino acid sequence of SEQ ID NO:448; and (f) a light chain variable region CDR3 comprising the amino acid sequence of SEQ ID NO:545.

In certain embodiments, an anti-FcRL5 scFv antibody comprises: (a) a heavy chain variable region CDR1 comprising the amino acid sequence of SEQ ID NO:372; (b) a heavy chain variable region CDR2 comprising the amino acid sequence of SEQ ID NO:475; (c) a heavy chain variable region CDR3 comprising the amino acid sequence of SEQ ID NO:570; (d) a light chain variable region CDR1 comprising the amino acid sequence of SEQ ID NO:571; (e) a light chain variable region CDR2 comprising the amino acid sequence of SEQ ID NO:572; and (f) a light chain variable region CDR3 comprising the amino acid sequence of SEQ ID NO:573.

In certain embodiments, an anti-FcRL5 scFv antibody comprises: (a) a heavy chain variable region CDR1 comprising the amino acid sequence of SEQ ID NO:440; (b) a heavy chain variable region CDR2 comprising the amino acid sequence of SEQ ID NO:441; (c) a heavy chain variable region CDR3 comprising the amino acid sequence of SEQ ID NO:442; (d) a light chain variable region CDR1 comprising the amino acid sequence of SEQ ID NO:329; (e) a light chain variable region CDR2 comprising the amino acid sequence of SEQ ID NO:330; and (f) a light chain variable region CDR3 comprising the amino acid sequence of SEQ ID NO:443.

In certain embodiments, an anti-FcRL5 scFv antibody comprises: (a) a heavy chain variable region CDR1 comprising the amino acid sequence of SEQ ID NO:309; (b) a heavy chain variable region CDR2 comprising the amino acid sequence of SEQ ID NO:310; (c) a heavy chain variable region CDR3 comprising the amino acid sequence of SEQ ID NO:489; (d) a light chain variable region CDR1 comprising the amino acid sequence of SEQ ID NO:490; (e) a light chain variable region CDR2 comprising the amino acid sequence of SEQ ID NO:313; and (f) a light chain variable region CDR3 comprising the amino acid sequence of SEQ ID NO:491.

The presently disclosed subject matter further provides anti-FcRL5 scFv antibodies comprising a heavy chain variable region, a light chain variable region and a linker peptide between the heavy chain variable region and the light chain variable region. In certain embodiments, the linker peptide comprises the amino acid sequence set forth in SEQ ID NO: 308 or 897. Non-limiting examples of anti-FcRL5 scFv antibodies of the present disclosure that comprise a heavy chain variable region, a light chain variable region and a linker peptide are disclosed in Tables 77-152.

For example, and not by way of limitation, an anti-FcRL5 scFv antibody having a heavy chain variable region, a light chain variable region and a linker peptide of the present disclosure comprises an amino acid sequence selected from the group consisting of SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742 and SEQ ID NO:744 (as shown in Tables 77-152).

In certain embodiments, an anti-FcRL5 scFv antibody having a heavy chain variable region, a light chain variable region and a linker peptide comprises the amino acid sequence of SEQ ID NO:664.

In certain embodiments, an anti-FcRL5 scFv antibody having a heavy chain variable region, a light chain variable region and a linker peptide comprises the amino acid sequence of SEQ ID NO:700.

In certain embodiments, an anti-FcRL5 scFv antibody having a heavy chain variable region, a light chain variable region and a linker peptide comprises the amino acid sequence of SEQ ID NO:702.

In certain embodiments, an anti-FcRL5 scFv antibody having a heavy chain variable region, a light chain variable region and a linker peptide comprises the amino acid sequence of SEQ ID NO:710.

In certain embodiments, an anti-FcRL5 scFv antibody having a heavy chain variable region, a light chain variable region and a linker peptide comprises the amino acid sequence of SEQ ID NO:726.

In certain embodiments, an anti-FcRL5 scFv antibody having a heavy chain variable region, a light chain variable region and a linker peptide comprises the amino acid sequence of SEQ ID NO:650.

In certain embodiments, an anti-FcRL5 scFv antibody having a heavy chain variable region, a light chain variable region and a linker peptide comprises the amino acid sequence of SEQ ID NO:678.

The presently disclosed subject matter further provides anti-FcRL5 scFv antibodies comprising a heavy chain variable region, a light chain variable region, a linker peptide between the heavy chain variable region and the light chain variable region, and a His-tag and a HA-tag. In certain embodiments, the amino acid sequence of the His-tag and HA-tag comprises the amino acid sequence of SEQ ID NO:308. The nucleotide sequence encoding SEQ ID NO: 308 is SEQ ID NO: 306. Non-limiting examples of anti-FcRL5 scFv antibodies of the present disclosure that comprise a His-tag and a HA-tag are disclosed in Tables 153-228.

In certain embodiments, an anti-FcRL5 scFv antibody having a heavy chain variable region, a light chain variable region, a linker peptide and a His-tag and a HA-tag comprises the amino acid sequence of SEQ ID NO:816.

In certain embodiments, an anti-FcRL5 scFv antibody having a heavy chain variable region, a light chain variable region, a linker peptide and a His-tag and a HA-tag comprises the amino acid sequence of SEQ ID NO:852.

In certain embodiments, an anti-FcRL5 scFv antibody having a heavy chain variable region, a light chain variable region, a linker peptide and a His-tag and a HA-tag comprises the amino acid sequence of SEQ ID NO:854.

In certain embodiments, an anti-FcRL5 scFv antibody having a heavy chain variable region, a light chain variable region, a linker peptide and a His-tag and a HA-tag comprises the amino acid sequence of SEQ ID NO:862.

In certain embodiments, an anti-FcRL5 scFv antibody having a heavy chain variable region, a light chain variable region, a linker peptide and a His-tag and a HA-tag comprises the amino acid sequence of SEQ ID NO:878.

In certain embodiments, an anti-FcRL5 scFv antibody having a heavy chain variable region, a light chain variable region, a linker peptide and a His-tag and a HA-tag comprises the amino acid sequence of SEQ ID NO:802.

In certain embodiments, an anti-FcRL5 scFv antibody having a heavy chain variable region, a light chain variable region, a linker peptide and a His-tag and a HA-tag comprises the amino acid sequence of SEQ ID NO:830.

2. Monoclonal Antibodies

The presently disclosed subject matter further provides antibodies (e.g., human monoclonal antibodies) that specifically bind to FcRL5 (e.g., human FcRL5) and were isolated and structurally characterized as described in Examples 1 and 2.

The $V_H$ amino acid sequences of human anti-FcRL5 antibodies ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 disclosed herein are set forth in SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, respectively, and are shown in Tables 1-76.

The $V_L$ amino acid sequences of human anti-FcRL5 antibodies ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 disclosed herein are set forth in SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303, respectively, and are shown in Tables 1-76.

Given that each of the disclosed anti-FcRL5 antibodies ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 antibodies can bind to FcRL5, the $V_H$ and $V_L$ sequences (shown in Tables 1-76) can be "mixed and matched" to create other anti-FcRL5 binding molecules. FcRL5 binding of such "mixed and matched" antibodies can be tested using the binding assays known in the art, including for example, ELISAs, Western blots, RIAs and Biacore analysis. In certain embodiments, when $V_H$ and $V_L$ chains are mixed and matched, a $V_H$ sequence from a particular $V_H/V_L$ pairing is replaced with a structurally similar $V_H$ sequence. Likewise, a $V_L$ sequence from a particular $V_H/V_L$ pairing is replaced with a structurally similar $V_L$ sequence.

In certain embodiments, the presently disclosed subject matter provides an isolated anti-FcRL5 antibody or antigen-binding fragment thereof comprising a light chain variable region, wherein the light chain variable region comprises an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303.

In certain embodiments, an isolated anti-FcRL5 antibody or antigen-binding fragment thereof comprises a heavy chain variable region, wherein the heavy chain variable region comprises an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, wherein the antibody or antigen-binding fragment thereof binds to an FcRL5 polypeptide.

In certain embodiments, the presently disclosed subject matter provides an isolated anti-FcRL5 antibody or antigen-binding fragment thereof comprising: (a) a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303; and (b) a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, wherein the antibody or antigen-binding fragment thereof binds to an FcRL5 polypeptide.

In certain embodiments, an isolated anti-FcRL5 antibody or antigen-binding fragment thereof comprises (a) a light chain variable region comprising amino acids having a sequence set forth in SEQ ID NO:3, and (b) a heavy chain variable region comprising amino acids having a sequence set forth in SEQ ID NO:4.

In certain embodiments, an isolated anti-FcRL5 antibody or antigen-binding fragment thereof comprises (a) a light chain variable region comprising amino acids having a sequence set forth in SEQ ID NO:7, and (b) a heavy chain variable region comprising amino acids having a sequence set forth in SEQ ID NO:8.

In certain embodiments, an isolated anti-FcRL5 antibody or antigen-binding fragment thereof comprises (a) a light chain variable region comprising amino acids having a sequence set forth in SEQ ID NO:11, and (b) a heavy chain variable region comprising amino acids having a sequence set forth in SEQ ID NO:12.

In certain embodiments, an isolated anti-FcRL5 antibody or antigen-binding fragment thereof comprises (a) a light chain variable region comprising amino acids having a sequence set forth in SEQ ID NO:15, and (b) a heavy chain variable region comprising amino acids having a sequence set forth in SEQ ID NO:16.

In certain embodiments, an isolated anti-FcRL5 antibody or antigen-binding fragment thereof comprises (a) a light chain variable region comprising amino acids having a sequence set forth in SEQ ID NO:19, and (b) a heavy chain variable region comprising amino acids having a sequence set forth in SEQ ID NO:20.

In certain embodiments, an isolated anti-FcRL5 antibody or antigen-binding fragment thereof comprises (a) a light chain variable region comprising amino acids having a sequence set forth in SEQ ID NO:23, and (b) a heavy chain variable region comprising amino acids having a sequence set forth in SEQ ID NO:24.

In certain embodiments, an isolated anti-FcRL5 antibody or antigen-binding fragment thereof comprises (a) a light chain variable region comprising amino acids having a sequence set forth in SEQ ID NO:27, and (b) a heavy chain variable region comprising amino acids having a sequence set forth in SEQ ID NO:28.

In certain embodiments, an isolated anti-FcRL5 antibody or antigen-binding fragment thereof comprises (a) a light chain variable region comprising amino acids having a sequence set forth in SEQ ID NO:31, and (b) a heavy chain variable region comprising amino acids having a sequence set forth in SEQ ID NO:32.

In certain embodiments, an isolated anti-FcRL5 antibody or antigen-binding fragment thereof comprises (a) a light chain variable region comprising amino acids having a sequence set forth in SEQ ID NO:35, and (b) a heavy chain variable region comprising amino acids having a sequence set forth in SEQ ID NO:36.

In certain embodiments, an isolated anti-FcRL5 antibody or antigen-binding fragment thereof comprises (a) a light chain variable region comprising amino acids having a sequence set forth in SEQ ID NO:39, and (b) a heavy chain variable region comprising amino acids having a sequence set forth in SEQ ID NO:40.

In certain embodiments, an isolated anti-FcRL5 antibody or antigen-binding fragment thereof comprises (a) a light chain variable region comprising amino acids having a sequence set forth in SEQ ID NO:43, and (b) a heavy chain variable region comprising amino acids having a sequence set forth in SEQ ID NO:44.

In certain embodiments, an isolated anti-FcRL5 antibody or antigen-binding fragment thereof comprises (a) a light chain variable region comprising amino acids having a sequence set forth in SEQ ID NO:47, and (b) a heavy chain variable region comprising amino acids having a sequence set forth in SEQ ID NO:48.

In certain embodiments, an isolated anti-FcRL5 antibody or antigen-binding fragment thereof comprises (a) a light chain variable region comprising amino acids having a sequence set forth in SEQ ID NO:51, and (b) a heavy chain variable region comprising amino acids having a sequence set forth in SEQ ID NO:52.

In certain embodiments, an isolated anti-FcRL5 antibody or antigen-binding fragment thereof comprises (a) a light chain variable region comprising amino acids having a sequence set forth in SEQ ID NO:55, and (b) a heavy chain variable region comprising amino acids having a sequence set forth in SEQ ID NO:56.

In certain embodiments, an isolated anti-FcRL5 antibody or antigen-binding fragment thereof comprises (a) a light chain variable region comprising amino acids having a sequence set forth in SEQ ID NO:59, and (b) a heavy chain variable region comprising amino acids having a sequence set forth in SEQ ID NO:60.

In certain embodiments, an isolated anti-FcRL5 antibody or antigen-binding fragment thereof comprises (a) a light chain variable region comprising amino acids having a sequence set forth in SEQ ID NO:63, and (b) a heavy chain variable region comprising amino acids having a sequence set forth in SEQ ID NO:64.

In certain embodiments, an isolated anti-FcRL5 antibody or antigen-binding fragment thereof comprises (a) a light chain variable region comprising amino acids having a sequence set forth in SEQ ID NO:67, and (b) a heavy chain variable region comprising amino acids having a sequence set forth in SEQ ID NO:68.

In certain embodiments, an isolated anti-FcRL5 antibody or antigen-binding fragment thereof comprises (a) a light chain variable region comprising amino acids having a sequence set forth in SEQ ID NO:71, and (b) a heavy chain variable region comprising amino acids having a sequence set forth in SEQ ID NO:72.

In certain embodiments, an isolated anti-FcRL5 antibody or antigen-binding fragment thereof comprises (a) a light chain variable region comprising amino acids having a sequence set forth in SEQ ID NO:75, and (b) a heavy chain variable region comprising amino acids having a sequence set forth in SEQ ID NO:76.

In certain embodiments, an isolated anti-FcRL5 antibody or antigen-binding fragment thereof comprises (a) a light chain variable region comprising amino acids having a sequence set forth in SEQ ID NO:79, and (b) a heavy chain variable region comprising amino acids having a sequence set forth in SEQ ID NO:80.

In certain embodiments, an isolated anti-FcRL5 antibody or antigen-binding fragment thereof comprises (a) a light chain variable region comprising amino acids having a sequence set forth in SEQ ID NO:83, and (b) a heavy chain variable region comprising amino acids having a sequence set forth in SEQ ID NO:84.

In certain embodiments, an isolated anti-FcRL5 antibody or antigen-binding fragment thereof comprises (a) a light chain variable region comprising amino acids having a sequence set forth in SEQ ID NO:87, and (b) a heavy chain variable region comprising amino acids having a sequence set forth in SEQ ID NO:88.

In certain embodiments, an isolated anti-FcRL5 antibody or antigen-binding fragment thereof comprises (a) a light chain variable region comprising amino acids having a sequence set forth in SEQ ID NO:91, and (b) a heavy chain variable region comprising amino acids having a sequence set forth in SEQ ID NO:92.

In certain embodiments, an isolated anti-FcRL5 antibody or antigen-binding fragment thereof comprises (a) a light chain variable region comprising amino acids having a sequence set forth in SEQ ID NO:95, and (b) a heavy chain variable region comprising amino acids having a sequence set forth in SEQ ID NO:96.

In certain embodiments, an isolated anti-FcRL5 antibody or antigen-binding fragment thereof comprises (a) a light chain variable region comprising amino acids having a sequence set forth in SEQ ID NO:99, and (b) a heavy chain variable region comprising amino acids having a sequence set forth in SEQ ID NO:100.

In certain embodiments, an isolated anti-FcRL5 antibody or antigen-binding fragment thereof comprises (a) a light chain variable region comprising amino acids having a sequence set forth in SEQ ID NO:103, and (b) a heavy chain variable region comprising amino acids having a sequence set forth in SEQ ID NO:104.

In certain embodiments, an isolated anti-FcRL5 antibody or antigen-binding fragment thereof comprises (a) a light chain variable region comprising amino acids having a sequence set forth in SEQ ID NO:107, and (b) a heavy chain variable region comprising amino acids having a sequence set forth in SEQ ID NO:108.

In certain embodiments, an isolated anti-FcRL5 antibody or antigen-binding fragment thereof comprises (a) a light chain variable region comprising amino acids having a sequence set forth in SEQ ID NO:111, and (b) a heavy chain variable region comprising amino acids having a sequence set forth in SEQ ID NO:112.

In certain embodiments, an isolated anti-FcRL5 antibody or antigen-binding fragment thereof comprises (a) a light chain variable region comprising amino acids having a sequence set forth in SEQ ID NO:115, and (b) a heavy chain variable region comprising amino acids having a sequence set forth in SEQ ID NO:116.

In certain embodiments, an isolated anti-FcRL5 antibody or antigen-binding fragment thereof comprises (a) a light chain variable region comprising amino acids having a sequence set forth in SEQ ID NO:119, and (b) a heavy chain variable region comprising amino acids having a sequence set forth in SEQ ID NO:120.

In certain embodiments, an isolated anti-FcRL5 antibody or antigen-binding fragment thereof comprises (a) a light chain variable region comprising amino acids having a sequence set forth in SEQ ID NO:123, and (b) a heavy chain variable region comprising amino acids having a sequence set forth in SEQ ID NO:124.

In certain embodiments, an isolated anti-FcRL5 antibody or antigen-binding fragment thereof comprises (a) a light chain variable region comprising amino acids having a sequence set forth in SEQ ID NO:127, and (b) a heavy chain variable region comprising amino acids having a sequence set forth in SEQ ID NO:128.

In certain embodiments, an isolated anti-FcRL5 antibody or antigen-binding fragment thereof comprises (a) a light chain variable region comprising amino acids having a sequence set forth in SEQ ID NO:131, and (b) a heavy chain variable region comprising amino acids having a sequence set forth in SEQ ID NO:132.

In certain embodiments, an isolated anti-FcRL5 antibody or antigen-binding fragment thereof comprises (a) a light chain variable region comprising amino acids having a sequence set forth in SEQ ID NO:135, and (b) a heavy chain variable region comprising amino acids having a sequence set forth in SEQ ID NO:136.

In certain embodiments, an isolated anti-FcRL5 antibody or antigen-binding fragment thereof comprises (a) a light chain variable region comprising amino acids having a sequence set forth in SEQ ID NO:139, and (b) a heavy chain variable region comprising amino acids having a sequence set forth in SEQ ID NO:140.

In certain embodiments, an isolated anti-FcRL5 antibody or antigen-binding fragment thereof comprises (a) a light chain variable region comprising amino acids having a sequence set forth in SEQ ID NO:143, and (b) a heavy chain variable region comprising amino acids having a sequence set forth in SEQ ID NO:144.

In certain embodiments, an isolated anti-FcRL5 antibody or antigen-binding fragment thereof comprises (a) a light chain variable region comprising amino acids having a sequence set forth in SEQ ID NO:147, and (b) a heavy chain variable region comprising amino acids having a sequence set forth in SEQ ID NO:148.

In certain embodiments, an isolated anti-FcRL5 antibody or antigen-binding fragment thereof comprises (a) a light chain variable region comprising amino acids having a sequence set forth in SEQ ID NO:151, and (b) a heavy chain variable region comprising amino acids having a sequence set forth in SEQ ID NO:152.

In certain embodiments, an isolated anti-FcRL5 antibody or antigen-binding fragment thereof comprises (a) a light chain variable region comprising amino acids having a sequence set forth in SEQ ID NO:155, and (b) a heavy chain variable region comprising amino acids having a sequence set forth in SEQ ID NO:156.

In certain embodiments, an isolated anti-FcRL5 antibody or antigen-binding fragment thereof comprises (a) a light chain variable region comprising amino acids having a sequence set forth in SEQ ID NO:159, and (b) a heavy chain variable region comprising amino acids having a sequence set forth in SEQ ID NO:160.

In certain embodiments, an isolated anti-FcRL5 antibody or antigen-binding fragment thereof comprises (a) a light chain variable region comprising amino acids having a sequence set forth in SEQ ID NO:163, and (b) a heavy chain variable region comprising amino acids having a sequence set forth in SEQ ID NO:164.

In certain embodiments, an isolated anti-FcRL5 antibody or antigen-binding fragment thereof comprises (a) a light chain variable region comprising amino acids having a sequence set forth in SEQ ID NO:167, and (b) a heavy chain variable region comprising amino acids having a sequence set forth in SEQ ID NO:168.

In certain embodiments, an isolated anti-FcRL5 antibody or antigen-binding fragment thereof comprises (a) a light chain variable region comprising amino acids having a sequence set forth in SEQ ID NO:171, and (b) a heavy chain variable region comprising amino acids having a sequence set forth in SEQ ID NO:172.

In certain embodiments, an isolated anti-FcRL5 antibody or antigen-binding fragment thereof comprises (a) a light chain variable region comprising amino acids having a sequence set forth in SEQ ID NO:175, and (b) a heavy chain variable region comprising amino acids having a sequence set forth in SEQ ID NO:176.

In certain embodiments, an isolated anti-FcRL5 antibody or antigen-binding fragment thereof comprises (a) a light chain variable region comprising amino acids having a sequence set forth in SEQ ID NO:179, and (b) a heavy chain variable region comprising amino acids having a sequence set forth in SEQ ID NO:180.

In certain embodiments, an isolated anti-FcRL5 antibody or antigen-binding fragment thereof comprises (a) a light chain variable region comprising amino acids having a sequence set forth in SEQ ID NO:183, and (b) a heavy chain variable region comprising amino acids having a sequence set forth in SEQ ID NO:184.

In certain embodiments, an isolated anti-FcRL5 antibody or antigen-binding fragment thereof comprises (a) a light chain variable region comprising amino acids having a sequence set forth in SEQ ID NO:187, and (b) a heavy chain variable region comprising amino acids having a sequence set forth in SEQ ID NO:188.

In certain embodiments, an isolated anti-FcRL5 antibody or antigen-binding fragment thereof comprises (a) a light chain variable region comprising amino acids having a sequence set forth in SEQ ID NO:191, and (b) a heavy chain variable region comprising amino acids having a sequence set forth in SEQ ID NO:192.

In certain embodiments, an isolated anti-FcRL5 antibody or antigen-binding fragment thereof comprises (a) a light chain variable region comprising amino acids having a sequence set forth in SEQ ID NO:195, and (b) a heavy chain variable region comprising amino acids having a sequence set forth in SEQ ID NO:196.

In certain embodiments, an isolated anti-FcRL5 antibody or antigen-binding fragment thereof comprises (a) a light chain variable region comprising amino acids having a sequence set forth in SEQ ID NO:199, and (b) a heavy chain variable region comprising amino acids having a sequence set forth in SEQ ID NO:200.

In certain embodiments, an isolated anti-FcRL5 antibody or antigen-binding fragment thereof comprises (a) a light chain variable region comprising amino acids having a sequence set forth in SEQ ID NO:203, and (b) a heavy chain variable region comprising amino acids having a sequence set forth in SEQ ID NO:204.

In certain embodiments, an isolated anti-FcRL5 antibody or antigen-binding fragment thereof comprises (a) a light chain variable region comprising amino acids having a sequence set forth in SEQ ID NO:207, and (b) a heavy chain variable region comprising amino acids having a sequence set forth in SEQ ID NO:208.

In certain embodiments, an isolated anti-FcRL5 antibody or antigen-binding fragment thereof comprises (a) a light chain variable region comprising amino acids having a sequence set forth in SEQ ID NO:211, and (b) a heavy chain variable region comprising amino acids having a sequence set forth in SEQ ID NO:212.

In certain embodiments, an isolated anti-FcRL5 antibody or antigen-binding fragment thereof comprises (a) a light chain variable region comprising amino acids having a sequence set forth in SEQ ID NO:215, and (b) a heavy chain variable region comprising amino acids having a sequence set forth in SEQ ID NO:216.

In certain embodiments, an isolated anti-FcRL5 antibody or antigen-binding fragment thereof comprises (a) a light chain variable region comprising amino acids having a sequence set forth in SEQ ID NO:219, and (b) a heavy chain variable region comprising amino acids having a sequence set forth in SEQ ID NO:220.

In certain embodiments, an isolated anti-FcRL5 antibody or antigen-binding fragment thereof comprises (a) a light chain variable region comprising amino acids having a sequence set forth in SEQ ID NO:223, and (b) a heavy chain variable region comprising amino acids having a sequence set forth in SEQ ID NO:224.

In certain embodiments, an isolated anti-FcRL5 antibody or antigen-binding fragment thereof comprises (a) a light chain variable region comprising amino acids having a sequence set forth in SEQ ID NO:227, and (b) a heavy chain variable region comprising amino acids having a sequence set forth in SEQ ID NO:228.

In certain embodiments, an isolated anti-FcRL5 antibody or antigen-binding fragment thereof comprises (a) a light chain variable region comprising amino acids having a sequence set forth in SEQ ID NO:231, and (b) a heavy chain variable region comprising amino acids having a sequence set forth in SEQ ID NO:232.

In certain embodiments, an isolated anti-FcRL5 antibody or antigen-binding fragment thereof comprises (a) a light chain variable region comprising amino acids having a sequence set forth in SEQ ID NO:235, and (b) a heavy chain variable region comprising amino acids having a sequence set forth in SEQ ID NO:236.

In certain embodiments, an isolated anti-FcRL5 antibody or antigen-binding fragment thereof comprises (a) a light chain variable region comprising amino acids having a sequence set forth in SEQ ID NO:239, and (b) a heavy chain variable region comprising amino acids having a sequence set forth in SEQ ID NO:240.

In certain embodiments, an isolated anti-FcRL5 antibody or antigen-binding fragment thereof comprises (a) a light chain variable region comprising amino acids having a sequence set forth in SEQ ID NO:243, and (b) a heavy chain variable region comprising amino acids having a sequence set forth in SEQ ID NO:244.

In certain embodiments, an isolated anti-FcRL5 antibody or antigen-binding fragment thereof comprises (a) a light chain variable region comprising amino acids having a sequence set forth in SEQ ID NO:247, and (b) a heavy chain variable region comprising amino acids having a sequence set forth in SEQ ID NO:248.

In certain embodiments, an isolated anti-FcRL5 antibody or antigen-binding fragment thereof comprises (a) a light chain variable region comprising amino acids having a sequence set forth in SEQ ID NO:251, and (b) a heavy chain variable region comprising amino acids having a sequence set forth in SEQ ID NO:252.

In certain embodiments, an isolated anti-FcRL5 antibody or antigen-binding fragment thereof comprises (a) a light chain variable region comprising amino acids having a sequence set forth in SEQ ID NO:255, and (b) a heavy chain variable region comprising amino acids having a sequence set forth in SEQ ID NO:256.

In certain embodiments, an isolated anti-FcRL5 antibody or antigen-binding fragment thereof comprises (a) a light chain variable region comprising amino acids having a sequence set forth in SEQ ID NO:259, and (b) a heavy chain variable region comprising amino acids having a sequence set forth in SEQ ID NO:260.

In certain embodiments, an isolated anti-FcRL5 antibody or antigen-binding fragment thereof comprises (a) a light chain variable region comprising amino acids having a sequence set forth in SEQ ID NO:263, and (b) a heavy chain variable region comprising amino acids having a sequence set forth in SEQ ID NO:264.

In certain embodiments, an isolated anti-FcRL5 antibody or antigen-binding fragment thereof comprises (a) a light chain variable region comprising amino acids having a sequence set forth in SEQ ID NO:267, and (b) a heavy chain variable region comprising amino acids having a sequence set forth in SEQ ID NO:268.

In certain embodiments, an isolated anti-FcRL5 antibody or antigen-binding fragment thereof comprises (a) a light chain variable region comprising amino acids having a sequence set forth in SEQ ID NO:271, and (b) a heavy chain variable region comprising amino acids having a sequence set forth in SEQ ID NO:272.

In certain embodiments, an isolated anti-FcRL5 antibody or antigen-binding fragment thereof comprises (a) a light chain variable region comprising amino acids having a sequence set forth in SEQ ID NO:275, and (b) a heavy chain variable region comprising amino acids having a sequence set forth in SEQ ID NO:276.

In certain embodiments, an isolated anti-FcRL5 antibody or antigen-binding fragment thereof comprises (a) a light chain variable region comprising amino acids having a sequence set forth in SEQ ID NO:279, and (b) a heavy chain variable region comprising amino acids having a sequence set forth in SEQ ID NO:280.

In certain embodiments, an isolated anti-FcRL5 antibody or antigen-binding fragment thereof comprises (a) a light chain variable region comprising amino acids having a sequence set forth in SEQ ID NO:283, and (b) a heavy chain variable region comprising amino acids having a sequence set forth in SEQ ID NO:284.

In certain embodiments, an isolated anti-FcRL5 antibody or antigen-binding fragment thereof comprises (a) a light chain variable region comprising amino acids having a sequence set forth in SEQ ID NO:287, and (b) a heavy chain variable region comprising amino acids having a sequence set forth in SEQ ID NO:288.

In certain embodiments, an isolated anti-FcRL5 antibody or antigen-binding fragment thereof comprises (a) a light chain variable region comprising amino acids having a sequence set forth in SEQ ID NO:291, and (b) a heavy chain variable region comprising amino acids having a sequence set forth in SEQ ID NO:292.

In certain embodiments, an isolated anti-FcRL5 antibody or antigen-binding fragment thereof comprises (a) a light chain variable region comprising amino acids having a sequence set forth in SEQ ID NO:279, and (b) a heavy chain variable region comprising amino acids having a sequence set forth in SEQ ID NO:280.

In certain embodiments, an isolated anti-FcRL5 antibody or antigen-binding fragment thereof comprises (a) a light chain variable region comprising amino acids having a sequence set forth in SEQ ID NO:283, and (b) a heavy chain variable region comprising amino acids having a sequence set forth in SEQ ID NO:284.

In certain embodiments, an isolated anti-FcRL5 antibody or antigen-binding fragment thereof comprises (a) a light chain variable region comprising amino acids having a sequence set forth in SEQ ID NO:287, and (b) a heavy chain variable region comprising amino acids having a sequence set forth in SEQ ID NO:288.

In certain embodiments, an isolated anti-FcRL5 antibody or antigen-binding fragment thereof comprises (a) a light chain variable region comprising amino acids having a sequence set forth in SEQ ID NO:291, and (b) a heavy chain variable region comprising amino acids having a sequence set forth in SEQ ID NO:292.

In certain embodiments, an isolated anti-FcRL5 antibody or antigen-binding fragment thereof comprises (a) a light chain variable region comprising amino acids having a sequence set forth in SEQ ID NO:295, and (b) a heavy chain variable region comprising amino acids having a sequence set forth in SEQ ID NO:296.

In certain embodiments, an isolated anti-FcRL5 antibody or antigen-binding fragment thereof comprises (a) a light chain variable region comprising amino acids having a sequence set forth in SEQ ID NO:299, and (b) a heavy chain variable region comprising amino acids having a sequence set forth in SEQ ID NO:300.

In certain embodiments, an isolated anti-FcRL5 antibody or antigen-binding fragment thereof comprises (a) a light chain variable region comprising amino acids having a sequence set forth in SEQ ID NO:303, and (b) a heavy chain variable region comprising amino acids having a sequence set forth in SEQ ID NO:304.

In certain embodiments, the presently disclosed subject matter provides antibodies that comprise the heavy chain variable region and light chain variable region CDR1s, CDR2s and CDR3s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 shown in Table 229.

The amino acid sequences of the $V_H$ CDR1s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 are shown in Table 229.

The amino acid sequences of the $V_H$ CDR2s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 are shown in Table 229.

The amino acid sequences of the $V_H$ CDR3s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 are shown in Table 229.

The amino acid sequences of the $V_L$ CDR1s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 are shown in Table 229.

The amino acid sequences of the V$_L$ CDR2s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 are shown in Table 229.

The amino acid sequences of the V$_L$ CDR3s of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 are shown in Table 229.

Given that each of the disclosed antibodies can bind to FcRL5 and that antigen-binding specificity is provided primarily by the CDR1, CDR2, and CDR3 regions, the V$_H$ CDR1, CDR2, and CDR3 sequences and V$_L$ CDR1, CDR2, and CDR3 sequences can be "mixed and matched" (i.e., CDRs from different antibodies can be mixed and match, although each antibody must contain a V$_H$ CDR1, CDR2, and CDR3 and a V$_L$ CDR1, CDR2, and CDR3) to create other anti-FcRL5 binding molecules. FcRL5 binding of such "mixed and matched" antibodies can be tested using the binding assays described above. When V$_H$ CDR sequences are mixed and matched, the CDR1, CDR2 and/or CDR3 sequence from a particular V$_H$ sequence is replaced with a structurally similar CDR sequence(s). Likewise, when V$_L$ CDR sequences are mixed and matched, the CDR1, CDR2 and/or CDR3 sequence from a particular V$_L$ sequence preferably is replaced with a structurally similar CDR sequence(s). It will be readily apparent to the ordinarily skilled artisan that novel V$_H$ and V$_L$ sequences can be created by substituting one or more V$_H$ and/or V$_L$ CDR region sequences with structurally similar sequences from the CDR sequences of the antibodies ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 disclosed herein. See Table 229.

For example, and not by way of limitation, an isolated anti-FcRL5 antibody or antigen-binding fragment thereof comprises a light chain variable region, wherein the light chain variable region comprises: (a) a CDR1 comprising an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585 and 588; (b) a CDR2 comprising an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575 and 586; and (c) a CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592, and wherein the antibody or antigen-binding fragment thereof specifically binds FcRL5.

In certain embodiments, the presently disclosed subject matter provides an isolated anti-FcRL5 antibody or antigen-binding fragment thereof, comprising a heavy chain variable region, wherein the heavy chain variable region comprises: (a) a CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582 and 589; (b) a CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583 and 590; and (c) a CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591, and wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591; and (b) a light chain variable region CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592, wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:463; and (b) a light chain variable region CDR3 comprising the amino acid sequence of SEQ ID NO:419; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:517; and (b) a light chain variable region CDR3 comprising the amino acid sequence of SEQ ID NO:531; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:532; and (b) a light chain variable region CDR3 comprising the amino acid sequence of SEQ ID NO:535; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:543; and (b) a light chain variable region CDR3 comprising the amino acid sequence of SEQ ID NO:545; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:570; and (b) a light chain variable region CDR3 comprising the amino acid sequence of SEQ ID NO:573; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:442; and (b) a light chain variable region CDR3 comprising the amino acid sequence of SEQ ID NO:443; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR3 comprising the amino acid sequence of SEQ ID NO:489; and (b) a light chain variable region CDR3 comprising the amino acid sequence of SEQ ID NO:491; wherein the antibody or antigen-binding fragment thereof specifically binds FcRL5.

In certain embodiments, the presently disclosed subject matter provides an isolated anti-FcRL5 antibody or antigen-binding fragment thereof comprising: (a) a heavy chain variable region CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582 and 589; (b) a heavy chain variable region CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583 and 590; (c) a heavy chain variable region CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591; (d) a light chain variable region CDR1 comprising an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585 and 588; (e) a light chain variable region CDR2 comprising an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575 and 586; and (f) a light chain variable region CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592; wherein the anti-FcRL5 antibody or antigen-binding fragment thereof binds to FcRL5.

In certain embodiments, a presently disclosed anti-FcRL5 antibody or antigen-binding fragment thereof comprises: (a) a heavy chain variable region CDR1 comprising the amino acid sequence of SEQ ID NO:411; (b) a heavy chain variable region CDR2 comprising the amino acid sequence of SEQ ID NO:412; (c) a heavy chain variable region CDR3 comprising the amino acid sequence of SEQ ID NO:463; (d) a light chain variable region CDR1 comprising the amino acid sequence of SEQ ID NO:318; (e) a light chain variable region CDR2 comprising the amino acid sequence of SEQ ID NO:319; and (f) a light chain variable region CDR3 comprising the amino acid sequence of SEQ ID NO:419.

In certain embodiments, a presently disclosed anti-FcRL5 antibody or antigen-binding fragment thereof comprises: (a) a heavy chain variable region CDR1 comprising the amino acid sequence of SEQ ID NO:515; (b) a heavy chain variable region CDR2 comprising the amino acid sequence of SEQ ID NO:516; (c) a heavy chain variable region CDR3 comprising the amino acid sequence of SEQ ID NO:517; (d) a light chain variable region CDR1 comprising the amino acid sequence of SEQ ID NO:318; (e) a light chain variable region CDR2 comprising the amino acid sequence of SEQ ID NO:319; and (f) a light chain variable region CDR3 comprising the amino acid sequence of SEQ ID NO:531.

In certain embodiments, a presently disclosed anti-FcRL5 antibody or antigen-binding fragment thereof comprises: (a) a heavy chain variable region CDR1 comprising the amino acid sequence of SEQ ID NO:403; (b) a heavy chain variable region CDR2 comprising the amino acid sequence of SEQ ID NO:404; (c) a heavy chain variable region CDR3 comprising the amino acid sequence of SEQ ID NO:532; (d) a light chain variable region CDR1 comprising the amino acid sequence of SEQ ID NO:533; (e) a light chain variable region CDR2 comprising the amino acid sequence of SEQ ID NO:534; and (f) a light chain variable region CDR3 comprising the amino acid sequence of SEQ ID NO:535.

In certain embodiments, a presently disclosed anti-FcRL5 antibody or antigen-binding fragment thereof comprises: (a) a heavy chain variable region CDR1 comprising the amino acid sequence of SEQ ID NO:411; (b) a heavy chain variable region CDR2 comprising the amino acid sequence of SEQ ID NO:412; (c) a heavy chain variable region CDR3 comprising the amino acid sequence of SEQ ID NO:543; (d) a light chain variable region CDR1 comprising the amino acid sequence of SEQ ID NO:544; (e) a light chain variable region CDR2 comprising the amino acid sequence of SEQ ID NO:448; and (f) a light chain variable region CDR3 comprising the amino acid sequence of SEQ ID NO:545.

In certain embodiments, a presently disclosed anti-FcRL5 antibody or antigen-binding fragment thereof comprises: (a) a heavy chain variable region CDR1 comprising the amino acid sequence of SEQ ID NO:372; (b) a heavy chain variable region CDR2 comprising the amino acid sequence of SEQ ID NO:475; (c) a heavy chain variable region CDR3 comprising the amino acid sequence of SEQ ID NO:570; (d) a light chain variable region CDR1 comprising the amino acid sequence of SEQ ID NO:571; (e) a light chain variable region CDR2 comprising the amino acid sequence of SEQ ID NO:572; and (f) a light chain variable region CDR3 comprising the amino acid sequence of SEQ ID NO:573.

In certain embodiments, a presently disclosed anti-FcRL5 antibody or antigen-binding fragment thereof comprises: (a) a heavy chain variable region CDR1 comprising the amino acid sequence of SEQ ID NO:440; (b) a heavy chain variable region CDR2 comprising the amino acid sequence of SEQ ID NO:441; (c) a heavy chain variable region CDR3 comprising the amino acid sequence of SEQ ID NO:442; (d) a light chain variable region CDR1 comprising the amino acid sequence of SEQ ID NO:329; (e) a light chain variable region CDR2 comprising the amino acid sequence of SEQ ID NO:330; and (f) a light chain variable region CDR3 comprising the amino acid sequence of SEQ ID NO:443.

In certain embodiments, a presently disclosed anti-FcRL5 antibody or antigen-binding fragment thereof comprises: (a) a heavy chain variable region CDR1 comprising the amino acid sequence of SEQ ID NO:309; (b) a heavy chain variable region CDR2 comprising the amino acid sequence of SEQ ID NO:310; (c) a heavy chain variable region CDR3 comprising the amino acid sequence of SEQ ID NO:489; (d) a light chain variable region CDR1 comprising the amino acid sequence of SEQ ID NO:490; (e) a light chain variable region CDR2 comprising the amino acid sequence of SEQ ID NO:313; and (f) a light chain variable region CDR3 comprising the amino acid sequence of SEQ ID NO:491.

In certain embodiments, the extracellular antigen-binding domain, e.g., the human scFv, comprises a heavy chain variable region, a light chain variable region, a linker peptide between the heavy chain variable region and the light chain variable region, and an His-tag and an HA-tag. In certain embodiments, the amino acid sequence of the His-tag and HA-tag comprises the amino acid sequence of SEQ ID NO:308. The nucleotide sequence encoding SEQ ID NO: 308 is SEQ ID NO: 306.

In certain embodiments, a presently disclosed anti-FcRL5 antibody is a fully-human antibody, e.g., any one of ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124. Fully-human mAbs are preferred for therapeutic use in humans because murine antibodies cause an immunogenicity reaction, known as the HAMA (human anti-mouse antibodies) response (Azinovic, et al. Survival benefit associated with human anti-mouse antibody (HAMA) in patients with B-cell malignancies. Cancer Immunol. Immunother. 2006; 55(12): 1451-8; Tjandra, et al. Development of human anti-murine antibody (HAMA) response in patients. Immunol. Cell Biol. 1990; 68(6):367-76), when administered to humans, causing serious side effects, including anaphylaxis and hypersensitivity reactions. This immunogenicity reaction is triggered by the human immune system recognizing the murine antibodies as foreign because of slightly different amino acid sequences from natural human antibodies.

The use of fully human phage display libraries has made it possible to select large numbers of antibody (Ab) repertoires for unique and rare Abs against very defined epitopes (for more details on phage display see McCafferty et al., Phage antibodies: filamentous phage displaying antibody variable domains. Nature, 348: 552-554 (1990)). The rapid identification of human Fab, Fab' or single chain Fv (scFV) fragments highly specific for tumor antigen-derived peptide-MHC complex molecules has thus become possible. Recently, immuno-toxins, generated by fusing TCR-like Fab specific for melanoma Ag MART-1 26-35/A2 or gp100 280-288/A2 to a truncated form of Pseudomonas endotoxin, have been shown to inhibit human melanoma growth both in vitro and in vivo (Klechevsky, et al. Antitumor activity of immunotoxins with T-cell receptor-like specificity against human melanoma xenografts. Cancer Res 2008; 68 (15): 6360-6367). In addition, by engineering full-length mAb using the Fab fragments, it is possible to directly generate a therapeutic human mAb, bypassing months of time-consuming work, normally needed for developing therapeutic mAbs.

The presently disclosed subject matter involves the development of a fully human mAb that recognizes, for example, a human FcRL5 polypeptide (e.g., one having the amino acid sequence set forth in SEQ ID NO:899) for cancer therapy. The presently disclosed subject matter further involves the development of a fully human mAb that recognizes at least a part of domain 9 of a human FcRL5 polypeptide (e.g., a polypeptide having the amino acid sequence set forth in SEQ ID NO:900 or 917) for cancer therapy. The presently disclosed subject matter further involves the development of a fully human mAb that recognizes at least a part of domain 8 of a human FcRL5 polypeptide for cancer therapy. The presently disclosed subject matter further involves the development of a fully human mAb that recognizes at least a part of domain 7 of a human FcRL5 polypeptide for cancer therapy. In certain embodiments, the presently disclosed subject provides fully human mAbs that are specific for domain 7, domain 8 or domain 9 of FcRL5 for cancer therapy.

3. Homologous Antibodies

In certain embodiments, an antibody of the presently disclosed subject matter comprises heavy and light chain variable regions comprising amino acid sequences that are homologous to the amino acid sequences of the antibodies described herein and as disclosed in Tables 1-76 (e.g., ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 antibodies), and wherein the antibodies retain the desired functional properties of the anti-FcRL5 antibodies of the presently disclosed subject matter.

For example, and not by way of limitation, the presently disclosed subject matter provides an isolated anti-FcRL5 antibody or antigen-binding fragment thereof comprising a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303, wherein the anti-FcRL5 antibody or antigen-binding fragment thereof binds to an FcRL5 polypeptide.

In certain embodiments, an isolated anti-FcRL5 antibody or antigen-binding fragment thereof, comprises a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, wherein the anti-FcRL5 antibody or antigen-binding fragment thereof binds to an FcRL5 polypeptide.

In certain embodiments, an isolated anti-FcRL5 antibody or antigen-binding fragment thereof, comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299 and SEQ ID NO:303; and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300 and SEQ ID NO:304, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:143, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:144, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:215, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:216, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:219, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:220, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:235, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:236, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:267, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:268, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:115, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:116, wherein the anti-FcRL5 antibody or antigen-binding fragment thereof binds to an FcRL5 polypeptide.

In certain embodiments, an isolated anti-FcRL5 antibody or antigen-binding fragment thereof comprises (a) a light chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:171, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:172, wherein the anti-FcRL5 antibody or antigen-binding fragment thereof binds to an FcRL5 polypeptide.

An anti-FcRL5 antibody or antigen-binding fragment thereof comprising $V_H$ and/or $V_L$ regions having high (i.e., 80% or greater) homology to the $V_H$ and $V_L$ regions of the sequences set forth above, can be obtained by mutagenesis (e.g., site-directed or PCR-mediated mutagenesis), followed by testing of the encoded altered antibody for retained function (i.e., the binding affinity) using the binding assays described herein. In certain embodiments, a $V_L$ sequence having at least 90%, 91%, 92%, 93%, 94%, 95%, 96%, 97%, 98% or 99% identity contains substitutions (e.g., conservative substitutions to generate conservative modifications of a sequence), insertions or deletions relative to the reference sequence, but an anti-FcRL5 antibody or antigen-binding fragment thereof comprising that sequence retains the ability to bind to FcRL5. In certain embodiments, a $V_H$ sequence having at least 90%, 91%, 92%, 93%, 94%, 95%, 96%, 97%, 98%, or 99% identity contains substitutions (e.g., conservative substitutions), insertions or deletions relative to the reference sequence, but an anti-FcRL5 antibody or antigen-binding fragment thereof comprising that sequence retains the ability to bind to FcRL5. In certain embodiments, a total of about 1 to about 10 amino acids have been substituted, inserted and/or deleted in the disclosed sequences. Non-limiting examples of conservative modifications are provided below, e.g., within Table 230.

As used herein, the percent homology between two amino acid sequences is equivalent to the percent identity between the two sequences. The percent identity between the two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent homology between two amino acid sequences can be determined using the algorithm of E. Meyers and W. Miller (Comput. Appl. Biosci., 4:11-17 (1988)) which has been incorporated into the ALIGN program (version 2.0), using a PAM120 weight residue table, a gap length penalty of 12 and a gap penalty of 4. In addition, the percent homology between two amino acid sequences can be determined using the Needleman and Wunsch (J. Mol. Biol. 48:444-453 (1970)) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the presently disclosed subject matter can further be used as a "query sequence" to perform a search against public databases to, for example, identify related sequences. Such searches can be performed using the) (BLAST program (version 2.0) of Altschul, et al. (1990) J. Mol. Biol. 215: 403-10. BLAST protein searches can be performed with the) (BLAST program, score=50, wordlength=3 to obtain amino acid sequences homologous to the antibody molecules of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., BLAST and NBLAST) can be used. (See www.ncbi.nlm.nih.gov).

4. Antibodies with Conservative Modifications

The present disclosure further provides antibodies and antigen-binding fragments thereof that comprise conservative modifications of the antibody sequences disclosed herein. For example, and not by way of limitation, an antibody or antigen-binding fragment thereof of the presently disclosed subject matter comprises a heavy chain variable region comprising CDR1, CDR2 and CDR3 sequences and a light chain variable region comprising CDR1, CDR2 and CDR3 sequences, wherein one or more of these CDR sequences comprise specified amino acid sequences based on the antibodies described herein (e.g., ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 antibodies), or conservative modifications thereof, and wherein the antibodies retain the desired functional properties of the anti-FcRL5 antibodies of the presently disclosed subject matter. See Table 229.

In certain embodiments, the presently disclosed subject matter provides an isolated anti-FcRL5 antibody or antigen-binding fragment thereof comprising a light chain variable region, wherein the light chain variable region comprises: (a) a CDR1 comprising an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585 and 588, and conservative modifications thereof; (b) a CDR2 comprising an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575 and 586, and conservative modifications thereof and (c) a CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592, and conservative modifications thereof wherein the antibody or antigen-binding fragment thereof specifically binds FcRL5.

In certain embodiments, the presently disclosed subject matter provides an isolated anti-FcRL5 antibody or antigen-binding fragment thereof comprising a heavy chain variable region, wherein the heavy chain variable region comprises: (a) a CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582 and 589, and conservative modifications thereof; (b) a CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583 and 590, and conservative modifications thereof; and (c) a CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591, and conservative modifications thereof; wherein the antibody or antigen-binding fragment thereof specifically binds FcRL5.

The presently disclosed subject matter provides an isolated anti-FcRL5 antibody or antigen-binding fragment thereof, comprising a heavy chain variable region comprising CDR1, CDR2, and CDR3 sequences and a light chain variable region comprising CDR1, CDR2, and CDR3 sequences, wherein: (a) the heavy chain variable region CDR3 comprises an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591, and conservative modifications thereof and (b) the light chain variable region CDR3 comprises an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592, and conservative modifications thereof; wherein the antibody or antigen-binding fragment thereof binds to human FcRL5.

In certain embodiments, the presently disclosed subject matter provides an isolated anti-FcRL5 antibody or antigen-binding fragment thereof, comprising a heavy chain variable region comprising CDR1, CDR2, and CDR3 sequences and a light chain variable region comprising CDR1, CDR2, and CDR3 sequences, wherein: (a) the heavy chain variable region CDR1 comprises an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582 and 589, and conservative modifications thereof; (b) the heavy chain variable region CDR2 comprises an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583 and 590, and conservative modifications thereof (c) the heavy chain variable region CDR3 comprises an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587 and 591, and conservative modifications thereof (d) the light chain variable region CDR1 comprises an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585 and 588, and conservative modifications thereof; (e) the light chain variable region CDR2 comprises an amino acid sequence selected from the group consisting of SEQ ID NOs: 313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575 and 586, and conservative modifications thereof; and (f) the light chain variable region CDR3 comprises an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581 and 592, and conservative modifications thereof; wherein the antibody or antigen-binding fragment thereof specifically binds FcRL5.

In certain embodiments, a presently disclosed anti-FcRL5 antibody or antigen-binding fragment thereof comprises: (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof (c) a heavy chain variable region CDR3 comprising the amino acid sequence of SEQ ID NO:463 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:419 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:515 or conservative modifications thereof; (b) a heavy chain variable region CDR2 comprising the amino acid sequence of SEQ ID NO:516 or conservative modifications thereof (c) a heavy chain variable region CDR3 comprising the amino acid sequence of SEQ ID NO:517 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:531 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:403 or conservative modifications thereof; (b) a heavy chain variable region CDR2 comprising the amino acid sequence of SEQ ID NO:404 or conservative modifications thereof; (c) a heavy chain variable region CDR3 comprising the amino acid sequence of SEQ ID NO:532 or conservative modifications thereof; (d) a light chain variable region CDR1 comprising the amino acid sequence of SEQ ID NO:533 or conservative modifications thereof; (e) a light chain variable region CDR2 comprising the amino acid sequence of SEQ ID NO:534 or conservative modifications thereof; and (f) a light chain variable region CDR3 comprising the amino acid sequence of SEQ ID NO:535 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:543 or conservative modifications thereof; (d) a light chain variable region CDR1 comprising the amino acid sequence of SEQ ID NO:544 or conservative modifications thereof; (e) a light chain variable region CDR2 comprising the amino acid sequence of SEQ ID NO:448 or conservative modifications thereof; and (f) a light chain variable region CDR3 comprising the amino acid sequence of SEQ ID NO:545 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:372 or conservative modifications thereof; (b) a heavy chain variable region CDR2 comprising the amino acid sequence of SEQ ID NO:475 or conservative modifications thereof; (c) a heavy chain variable region CDR3 comprising the amino acid sequence of SEQ ID NO:570 or conservative modifications thereof; (d) a light chain variable region CDR1 comprising the amino acid sequence of SEQ ID NO:571 or conservative modifications thereof; (e) a light chain variable region CDR2 comprising the amino acid sequence of SEQ ID NO:572 or conservative modifications thereof; and (f) a light chain variable region CDR3 comprising the amino acid sequence of SEQ ID NO:573 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:440 or conservative modifications thereof; (b) a heavy chain variable region CDR2 comprising the amino acid sequence of SEQ ID NO:441 or conservative modifications thereof; (c) a heavy chain variable region CDR3 comprising the amino acid sequence of SEQ ID NO:442 or conservative modifications thereof; (d) a light chain variable region CDR1 comprising the amino acid sequence of SEQ ID NO:329 or conservative modifications thereof; (e) a light chain variable region CDR2 comprising the amino acid sequence of SEQ ID NO:330 or conservative modifications thereof; and (f) a light chain variable region CDR3 comprising the amino acid sequence of SEQ ID NO:443 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:309 or conservative modifications thereof; (b) a heavy chain variable region CDR2 comprising the amino acid sequence of SEQ ID NO:310 or conservative modifications thereof; (c) a heavy chain variable region CDR3 comprising the amino acid sequence of SEQ ID NO:489 or conservative modifications thereof; (d) a light chain variable region CDR1 comprising the amino acid sequence of SEQ ID NO:490 or conservative modifications thereof; (e) a light chain variable region CDR2 comprising the amino acid sequence of SEQ ID NO:313 or conservative modifications thereof; and (f) a light chain variable region CDR3 comprising the amino acid sequence of SEQ ID NO:491 or conservative modifications thereof.

As used herein, the term "conservative sequence modifications" is intended to refer to amino acid modifications that do not significantly affect or alter the binding characteristics of the antibody containing the amino acid sequence. Such conservative modifications include amino acid substitutions, additions and deletions. Modifications can be introduced into an antibody of the invention by standard techniques known in the art, such as site-directed mutagenesis and PCR-mediated mutagenesis.

Conservative amino acid substitutions are ones in which the amino acid residue is replaced with an amino acid residue having a similar side chain. Families of amino acid residues having similar side chains have been defined in the art. Exemplary conservative amino acid substitutions are shown in Table 230. Amino acid substitutions may be introduced into an antibody of interest and the products screened for a desired activity, e.g., retained/improved antigen binding, decreased immunogenicity, or improved ADCC or CDC. In certain embodiments, a sequence disclosed herein, e.g., a CDR sequence, a $V_H$ sequence or a $V_L$ sequence, can have up to about one, up to about two, up to about three, up to about four, up to about five, up to about six, up to about seven, up to about eight, up to about nine or up to about ten amino acid residues that are modified and/or substituted.

TABLE 230

| Original Residue | Exemplary conservative amino acid Substitutions |
|---|---|
| Ala (A) | Val; Leu; Ile |
| Arg (R) | Lys; Gln; Asn |
| Asn (N) | Gln; His; Asp, Lys; Arg |
| Asp (D) | Glu; Asn |
| Cys (C) | Ser; Ala |
| Gln (Q) | Asn; Glu |
| Glu (E) | Asp; Gln |
| Gly (G) | Ala |
| His (H) | Asn; Gln; Lys; Arg |
| Ile (I) | Leu; Val; Met; Ala; Phe |
| Leu (L) | Ile; Val; Met; Ala; Phe |
| Lys (K) | Arg; Gln; Asn |
| Met (M) | Leu; Phe; Ile |
| Phe (F) | Trp; Leu; Val; Ile; Ala; Tyr |
| Pro (P) | Ala |
| Ser (S) | Thr |
| Thr (T) | Val; Ser |
| Trp (W) | Tyr; Phe |
| Tyr (Y) | Trp; Phe; Thr; Ser |
| Val (V) | Ile; Leu; Met; Phe; Ala |

Amino acids may be grouped according to common side-chain properties:
  hydrophobic: Norleucine, Met, Ala, Val, Leu, Ile;
  neutral hydrophilic: Cys, Ser, Thr, Asn, Gln;
  acidic: Asp, Glu;
  basic: His, Lys, Arg;
  residues that influence chain orientation: Gly, Pro;
  aromatic: Trp, Tyr, Phe.

In certain embodiments, non-conservative substitutions will entail exchanging a member of one of these classes for another class.

5. Anti-FcRL5 Antibodies that Cross-Compete for Binding to FcRL5 with Anti-FcRL5 Antibodies of the Invention The present application provides antibodies that cross-compete with any of the disclosed anti-FcRL5 antibodies for binding to FcRL5 (e.g., human FcRL5). The present application further provides antibodies that cross-compete with any of the disclosed anti-FcRL5 antibodies for binding to domain 7, domain 8 or domain 9 of FcRL5 (e.g., domain 7, domain 8 or domain 9 of human FcRL5). For example, and not by way of limitation, the cross-competing antibodies can bind to the same epitope region, e.g., same epitope, adjacent epitope or overlapping epitope as any of the anti-FcRL5 antibodies of the presently disclosed subject matter. In certain embodiments, the epitope is present within an immunoglobulin (Ig)-like domain of FcRL5, e.g., within domain 1, domain 2, domain 3, domain 4, domain 5, domain 6, domain 7, domain 8 or domain 9 of FcRL5 (see FIGS. 3A and 3C). In certain embodiments, the epitope is present within domain 9 of FcRL5. In certain embodiments, the epitope is present within domain 8 of FcRL5. In certain embodiments, the epitope is present within domain 7 of FcRL5.

In certain embodiments, the reference antibody for cross-competition studies can be any one of the anti-FcRL5 antibodies disclosed herein, e.g., ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 antibodies.

Such cross-competing antibodies can be identified based on their ability to cross-compete with any one of the presently disclosed anti-FcRL5 antibodies in standard FcRL5 binding assays. For example, Biacore analysis, ELISA assays or flow cytometry can be used to demonstrate cross-competition with the antibodies of the presently disclosed subject matter. The ability of a test antibody to inhibit the binding of, for example, any one of the presently disclosed anti-FcRL5 antibodies (e.g., ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 antibodies) to human FcRL5 demonstrates that the test antibody can compete with any one of the presently disclosed anti-FcRL5 antibodies for binding to human FcRL5 and thus binds to the same epitope region on human FcRL5 as any one of the presently disclosed anti-FcRL5 antibodies. In certain embodiments, the cross-competing antibody binds to the same epitope on human FcRL5 as any one of the presently disclosed anti-FcRL5 antibodies.

In a non-limiting example of a competition assay, immobilized antigen, e.g., a human FcRL5 polypeptide, can be incubated in a solution comprising a first labeled antibody that binds to the antigen and a second unlabeled antibody that is being tested for its ability to compete with the first antibody for binding to the antigen. In certain embodiments, the second antibody can be present in a hybridoma supernatant. As a control, immobilized antigen is incubated in a solution comprising the first labeled antibody but not the second unlabeled antibody. After incubation under conditions permissive for binding of the first antibody to the antigen, excess unbound antibody is removed, and the amount of label associated with immobilized antigen is measured. If the amount of label associated with immobilized antigen is substantially reduced, e.g., greater than about 50%, in the test sample relative to the control sample, then that indicates that the second antibody is competing with the first antibody for binding to the antigen. See Harlow and Lane (1988) *Antibodies: A Laboratory Manual* ch. 14 (Cold Spring Harbor Laboratory, Cold Spring Harbor, N.Y.).

In certain embodiments, an antibody that cross-competes with any one of the presently disclosed anti-FcRL5 antibodies has a $K_d$ of $5 \times 10^{-7}$ M or less, $1 \times 10^{-7}$ M or less, $5 \times 10^{-8}$ M or less, $1 \times 10^{-8}$ M or less, $5 \times 10^{-9}$ M or less, $1 \times 10^{-9}$ M or less, $5 \times 10^{-10}$ M or less, or $1 \times 10^{-10}$ M or less.

6. Characterization of Antibody Binding to Antigen

Antibodies of the presently disclosed subject can be tested for binding to FcRL5 by, for example, standard ELISA. To determine if the selected anti-FcRL5 antibodies bind to unique epitopes, each antibody can be biotinylated using commercially available reagents (Pierce, Rockford, Ill.). Competition studies using unlabeled monoclonal antibodies and biotinylated monoclonal antibodies can be performed using FcRL5 coated-ELISA plates as described above. Biotinylated mAb binding can be detected with a strep-avidin-alkaline phosphatase probe.

To determine the isotype of purified antibodies, isotype ELISAs can be performed using reagents specific for antibodies of a particular isotype. Anti-FcRL5 human IgGs can be further tested for reactivity with FcRL5 antigen by Western blotting.

In certain embodiments, $K_d$ is measured by a radiolabeled antigen binding assay (RIA). In certain embodiments, an RIA is performed with the Fab version of an antibody of interest and its antigen. For example, solution binding affinity of Fabs for antigen is measured by equilibrating Fab with a minimal concentration of ($^{125}$I)-labeled antigen in the presence of a titration series of unlabeled antigen, then capturing bound antigen with an anti-Fab antibody-coated plate (see, e.g., Chen et al., *J. Mol. Biol.* 293:865-881 (1999)).

In certain embodiments, $K_d$ is measured using a BIACORE® surface plasmon resonance assay. For example, an assay using BIACORE®-2000 or a BIACORE®-3000 (Biacore, Inc., Piscataway, N.J.) is described in the Biacore Assay Handbook (2012) available at http://www.gelifesciences.com.

In certain embodiments, an antibody or an antigen-binding fragment thereof of the present disclosure binds to a human FcRL5 polypeptide comprising the amino acid sequence set forth in SEQ ID NO: 899. In certain embodiments, an antibody or an antigen-binding fragment thereof of the present disclosure binds to an epitope in domain 9 (e.g., comprising amino acids 754-835 of SEQ ID NO:899). In certain embodiments, an antibody or an antigen-binding fragment thereof of the present disclosure binds to an epitope in domain 8 (e.g., comprising amino acids 658-731 of SEQ ID NO:899). In certain embodiments, an antibody or an antigen-binding fragment thereof of the presently disclosed subject matter binds to an epitope within domain 9 comprising amino acids 829-840 of SEQ ID NO:899. In certain embodiments, an antibody or an antigen-binding fragment thereof of the presently disclosed subject matter binds to an epitope within domain 8 comprising amino acids 657-667 of SEQ ID NO:899. For example, and not by way of limitation, an antibody or an antigen-binding fragment thereof of the present disclosure binds to an epitope comprising the amino acid sequence RSETVTLYITGL (SEQ ID NO:915). In certain embodiments, an antibody or an antigen-binding fragment thereof of the present disclosure binds to an epitope comprising the amino acid sequence SRPILTFRAPR (SEQ ID NO:916).

7. Immunoconjugates

The presently disclosed subject provides an anti-FcRL5 antibody, or a antigen-binding fragment thereof, conjugated to a therapeutic moiety (e.g., agent), such as a cytotoxin, a drug (e.g., an immunosuppressant) or a radiotoxin. Such conjugates are referred to herein as "immunoconjugates." Immunoconjugates that include one or more cytotoxins are referred to as "immunotoxins." A cytotoxin or cytotoxic agent includes any agent that is detrimental to (e.g., kills) cells. Non-limiting examples of cytotoxic agents include taxol (such as ricin, diphtheria and gelonin), cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents also include, for example, calecheamicin, aureastatin, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

Other examples of therapeutic cytotoxins that can be conjugated to an anti-FcRL5 antibody or antigen-binding fragment thereof disclosed herein include duocarmycins, calicheamicins, maytansines and auristatins, and derivatives thereof. An example of a calicheamicin antibody conjugate is commercially available (Mylotarg™; Wyeth-Ayerst).

Cytoxins can be conjugated to anti-FcRL5 antibody disclosed herein using linker technology available in the art. Examples of linker types that have been used to conjugate a cytotoxin to an antibody include, but are not limited to, hydrazones, thioethers, esters, disulfides and peptide-containing linkers. A linker can be chosen that is, for example, susceptible to cleavage by low pH within the lysosomal compartment or susceptible to cleavage by proteases, such as proteases preferentially expressed in tumor tissue such as cathepsins (e.g., cathepsins B, C, D). For further discussion of types of cytotoxins, linkers and methods for conjugating therapeutic agents to antibodies, see also Saito, G. et al. (2003) Adv. Drug Deliv. Rev. 55:199-215; Trail, P. A. et al. (2003) Cancer Immunol. Immunother. 52:328-337; Payne, G. (2003) Cancer Cell 3:207-212; Allen, T. M. (2002) Nat. Rev. Cancer 2:750-763; Pastan, I. and Kreitman, R. J. (2002) Curr. Opin. Investig. Drugs 3:1089-1091; Senter, P. D. and Springer, C. J. (2001) Adv. Drug Deliv. Rev. 53:247-264.

Anti-FcRL5 antibodies of the presently disclosed subject matter also can be conjugated to a radioactive isotope to generate cytotoxic radiopharmaceuticals, also referred to as radioimmunoconjugates. Examples of radioactive isotopes that can be conjugated to antibodies for use diagnostically or therapeutically include, but are not limited to, $^{90}$Y, $^{131}$I, $^{225}$Ac, $^{213}$Bi, $^{223}$Ra and $^{227}$Th. Methods for preparing radioimmunconjugates are established in the art. Examples of radioimmunoconjugates are commercially available, including Zevalin™ (DEC Pharmaceuticals) and Bexxar™ (Corixa Pharmaceuticals), and similar methods can be used to prepare radioimmunoconjugates using the antibodies of the invention.

The antibody conjugates of the presently disclosed subject matter can be used to modify a given biological response, and the drug moiety is not to be construed as limited to classical chemical therapeutic agents. For example, the drug moiety may be a protein or polypeptide possessing a desired biological activity. Such proteins may include, for example, an enzymatically active toxin, or active fragment thereof, such as abrin, ricin A, pseudomonas exotoxin, or diphtheria toxin; a protein such as tumor necrosis factor (TNF) or interferon-γ; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors.

Techniques for conjugating such therapeutic moieties to antibodies are well known, see, e.g., Amon et al., "Monoclonal Antibodies For Immunotargeting Of Drugs In Cancer Therapy," in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review," in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy," in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates," Immunol. Rev., 62:119-58 (1982).

8. Bispecific Molecules

The presently disclosed subject matter provides bispecific molecules comprising an anti-FcRL5 antibody or a fragment thereof disclosed herein. An antibody of the presently disclosed subject matter, or antigen-binding fragments thereof, can be derivatized or linked to another functional molecule, e.g., another peptide or protein (e.g., another antibody or ligand for a receptor) to generate a bispecific molecule that binds to at least two different binding sites or target molecules. The antibody of the presently disclosed subject matter can in fact be derivatized or linked to more than one other functional molecule to generate multispecific molecules that bind to more than two different binding sites and/or target molecules; such multispecific molecules are also intended to be encompassed by the term "bispecific molecule" as used herein. To create a bispecific molecule, a presently disclosed anti-FcRL5 antibody can be functionally linked (e.g., by chemical coupling, genetic fusion, noncovalent association or otherwise) to one or more other binding molecules, such as another antibody, antibody fragment, peptide or binding mimetic, such that a bispecific molecule results.

The presently disclosed subject matter provides bispecific molecules comprising at least a first binding specificity for FcRL5 and a second binding specificity for a second target epitope. The second target epitope can be a FcRL5 epitope, or a non-FcRL5 epitope, e.g., a different antigen. In certain embodiments, the bispecific molecule is multispecific, the molecule can further include a third binding specificity. Where a first portion of a bispecific antibody binds to an antigen on a tumor cell for example and a second portion of a bispecific antibody recognizes an antigen on the surface of a human immune effector cell, the antibody is capable of recruiting the activity of that effector cell by specifically binding to the effector antigen on the human immune effector cell. In certain embodiments, bispecific antibodies, therefore, are able to form a link between effector cells, for example, T cells and tumor cells, thereby enhancing effector function. In certain embodiments, a bispecific antibody of the present disclosure comprises at least a first binding to FcRL5 and at least a second binding to an immune cell. For example, and not by way of limitation, a bispecific antibody of the present disclosure comprises at least a first binding to FcRL5 and at least a second binding to a receptor present on the surface of an immune cell, e.g., CD3.

The bispecific molecules of the presently disclosed subject matter can be prepared by conjugating the constituent binding specificities using methods known in the art. For example, each binding specificity of the bispecific molecule can be generated separately and then conjugated to one another. When the binding specificities are proteins or peptides, a variety of coupling or cross-linking agents can be used for covalent conjugation. Examples of cross-linking agents include protein A, carbodiimide, N-succinimidyl-S-acetyl-thioacetate (SATA), 5, 5'-dithiobis(2-nitrobenzoic acid) (DTNB), o-phenylenedimaleimide (oPDM), N-succinimidyl-3-(2-pyridyldithio)propionate (SPDP), and sulfosuccinimidyl 4-(N-maleimidomethyl) cyclohaxane-1-carboxylate (sulfo-SMCC) (see, e.g., Karpovsky et al. (1984) J. Exp. Med. 160:1686; Liu, M A et al. (1985) Proc. Natl. Acad. Sci. USA 82:8648). Other methods include those described in Paulus (1985) Behring Ins. Mitt. No. 78, 118-132; Brennan et al. (1985) Science 229:81-83), and Glennie et al. (1987) J. Immunol. 139: 2367-2375). Preferred conjugating agents are SATA and sulfo-SMCC, both available from Pierce Chemical Co. (Rockford, Ill.).

When the binding specificities are antibodies, they can be conjugated via sulfhydryl bonding of the C-terminus hinge regions of the two heavy chains. In one non-limiting embodiment, the hinge region is modified to contain an odd number of sulfhydryl residues, preferably one, prior to conjugation.

Alternatively, both binding specificities can be encoded in the same vector and expressed and assembled in the same host cell. This method is particularly useful where the bispecific molecule is a mAb×mAb, mAb×Fab, Fab×F(ab')$_2$ or ligand x Fab fusion protein.

Binding of the bispecific molecules to their specific targets can be confirmed by, for example, enzyme-linked immunosorbent assay (ELISA), radioimmunoassay (RIA), FACS analysis, bioassay (e.g., growth inhibition), or Western Blot assay. Each of these assays generally detects the presence of protein-antibody complexes of particular interest by employing a labeled reagent (e.g., an antibody) specific for the complex of interest. Alternatively, the complexes can be detected using any of a variety of other immunoassays. For example, the antibody can be radioactively labeled and used in a radioimmunoassay (RIA) (see, for example, Weintraub, B., Principles of Radioimmunoassays, Seventh Training Course on Radioligand Assay Techniques, The Endocrine Society, March, 1986, which is incorporated by reference herein). The radioactive isotope can be detected by such means as the use of a γ counter or a scintillation counter or by autoradiography.

9. Selecting a High Affinity ScFv Against a FcRL5 Polypeptide

Phage display technology allows the selection of phage that bind to the target antigen of interest with high affinity from phage in a human phage display library that either does not bind or that binds with lower affinity. This is accomplished by iterative binding of phage to the antigen, which is bound to a solid support, for example, beads or mammalian cells followed by removal of non-bound phage and by elution of specifically bound phage. In certain embodiments, antigens are first biotinylated for immobilization to, for example, streptavidin-conjugated Dynabeads M-280. The phage library is incubated with the cells, beads or other solid support and non-binding phage is removed by washing. Clones that bind are selected and tested.

Once selected, positive scFv clones are further tested for their binding to FcRL5 (e.g., human FcRL5) on live 3T3 cell surfaces by flow cytometry. Briefly, phage clones are incubated with 3T3 cells over-expressing FcRL5. The cells are washed and then incubated with a mouse anti-M13 coat protein mAb. Cells are washed again and labeled with a PE-horse anti-mouse Ig prior to flow cytometry.

In certain embodiments, binding selectively for FcRL5 can be further confirmed by testing whether the positive scFv clones do not bind to other members of the FcRL family, such as, but not limited to, FcRL1, FcRL2, FcRL3, FcRL4 or FcRL6 and SLAMF9.

In other non-limiting embodiments, the anti-FcRL5 antibodies can comprise one or more framework region amino acid substitutions designed to improve protein stability, antibody binding, expression levels or to introduce a site for conjugation of therapeutic agents. These scFv are then used to produce recombinant human monoclonal IgGs in accordance with methods known to those of skill in the art.

10. Engineering Full Length mAb Using the Selected ScFv Fragments

Phage display technology allows for the rapid selection and production of antigen-specific scFv and Fab fragments, which are useful in and of themselves, or which can be further developed to provide complete antibodies, antigen binding proteins or antigen binding fragments thereof. Complete mAbs with Fc domains have a number of advantages over the scFv and Fab antibodies. First, only full length Abs exert immunological function such as CDC and ADCC mediated via Fc domain. Second, bivalent mAbs offer stronger antigen-binding affinity than monomeric Fab Abs. Third, plasma half-life and renal clearance will be different with the Fab and bivalent mAb. The particular features and advantages of each can be matched to the planned effector strategy. Fourth, bivalent mAb may be internalized at different rates than scFv and Fab, altering immune function or carrier function. Alpha emitters, for example, do not need to be internalized to kill the targets, but many drugs and toxins will benefit from internalization of the immune complex. In one non-limiting embodiment, therefore, once scFv clones specific for FcRL5 were obtained from phage display libraries, a full length IgG mAb using the scFv fragments was produced.

To produce recombinant human monoclonal IgG in Chinese hamster ovary (CHO) cells, a full length IgG mAb can be engineered based on a method known to those of skill in the art (Tomomatsu et al., Production of human monoclonal antibodies against FceRla by a method combining in vitro immunization with phage display. Biosci Biotechnol Biochem 73(7): 1465-1469 2009). Briefly, antibody variable regions can be subcloned into mammalian expression vectors, with matching Lambda or Kappa light chain constant sequences and IgG1 subclass Fc (for example) (Lidija P, et al. An integrated vector system for the eukaryotic expression of antibodies or their fragments after selection from phage display libraries. Gene 1997; 187(1): 9-18; Lisa J H, et al. Crystallographic structure of an intact lgG1 monoclonal antibody. Journal of Molecular Biology 1998; 275 (5): 861-872). Kinetic binding analysis (Yasmina N A, et al. Probing the binding mechanism and affinity of tanezumab, a recombinant humanized anti-NGF monoclonal antibody, using a repertoire of biosensors. Protein Science 2008; 17(8): 1326-1335) can be used to confirm specific binding of full length IgG to FcRL5, with a $K_d$ in nanomolar range.

Pharmaceutical Compositions and Methods of Treatment

Anti-FcRL5 antibodies or antigen-binding fragments thereof, e.g., scFvs, of the presently disclosed subject matter can be administered for therapeutic treatments to a patient suffering from a cancer (e.g., multiple myeloma) in an amount sufficient to prevent, inhibit or reduce the progression of the cancer. Progression includes, e.g., the growth, invasiveness, metastases and/or recurrence of the cancer, e.g., tumor. In certain embodiments, the method can include administering to a subject an effective amount of an anti-FcRL5 antibody or antigen-binding fragment thereof (or a pharmaceutical composition thereof) to produce an anti-cancer effect in the subject. Amounts effective for this use will depend upon the severity of the disease and the general state of the patient's own immune system. Dosing schedules will also vary with the disease state and status of the patient, and will typically range from a single bolus dosage or continuous infusion to multiple administrations per day (e.g., every 4-6 hours), or as indicated by the treating physician and the patient's condition.

An "anti-cancer effect" means one or more of: a reduction in aggregate cancer cell mass, a reduction in cancer cell growth rate, a reduction in cancer cell proliferation, a reduction in tumor mass, a reduction in tumor volume, a reduction in tumor cell proliferation, a reduction in tumor growth rate or a reduction in tumor metastasis. In certain embodiments, the anti-cancer effect is a reduction in the number of cancer cells. In certain embodiments, where the cancer is a solid tumor, an anti-cancer effect can be a reduction in tumor size and/or a reduction in the rate of tumor growth. In certain embodiments, the anti-cancer effect is a reduction in the aggregate cancer cell burden. In certain embodiments, the anti-cancer effect is a reduction in the rate of cell proliferation and/or an increase in the rate of cell death. In certain embodiments, the anti-cancer effect is a prolongation of survival. In certain embodiments, the anti-cancer effect is a prolongation in the interval until relapse.

The identification of medical conditions treatable by anti-FcRL5 antibodies of the presently disclosed subject matter is well within the ability and knowledge of one skilled in the art. For example, human individuals who are either suffering from multiple myeloma or who are at risk of developing multiple myeloma are suitable for administration of the presently disclosed anti-FcRL5 antibodies. A clinician skilled in the art can readily determine, for example, by the use of clinical tests, physical examination and medical/family history, if an individual is a candidate for such treatment.

In certain embodiments, the presently disclosed subject matter provides a method of treating a cancer, e.g., a tumor, by administering a presently disclosed anti-FcRL5 antibody and, optionally, in combination with one or more other agents. "In combination with" or "in conjunction with," as used interchangeably herein, means that the anti-FcRL5 antibody and the other agent are administered to a subject as part of a treatment regimen or plan. In certain embodiments, being used in combination does not require that the anti-FcRL5 antibody and the other agent are physically combined prior to administration or that they be administered over the same time frame. For example, and not by way of limitation, the anti-FcRL5 antibody and the other agent can be administered concurrently to the subject being treated, or can be administered at the same time or sequentially in any order or at different points in time. In certain embodiments, the presently disclosed subject matter provides a method of treating a cancer by administering a presently disclosed anti-FcRL5 antibody with an anti-neoplastic agent. The anti-FcRL5 antibody can be chemically or biosynthetically linked to one or more of the antineoplastic agents.

Non-limiting examples of suitable cancers that can be treated with the disclosed antibodies or antigen-binding fragments thereof include multiple myeloma, Non-Hodgkin Lymphoma (e.g., Mantle Cell), Hodgkin Lymphoma, Chronic Lymphocytic Leukemia (CLL), Acute lymphocytic leukemia (ALL), Hairy Cell Leukemia, Burketts Lymphoma and Waldenstrom's Macroglobulinemia. In certain embodiments, the cancer is multiple myeloma.

Any suitable method or route can be used to administer a presently disclosed anti-FcRL5 antibody, and optionally, to coadminister antineoplastic agents. Routes of administration include, for example, oral, intravenous, intraperitoneal, subcutaneous, or intramuscular administration. It should be emphasized, however, that the presently disclosed subject matter is not limited to any particular method or route of administration.

It is noted that presently disclosed anti-FcRL5 antibodies can be administered as a conjugate, which binds specifically to the receptor and delivers a toxic, lethal payload following ligand-toxin internalization.

The anti-FcRL5 antibodies of the presently disclosed subject matter can be administered in the form of a composition additionally comprising a pharmaceutically acceptable carrier. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the binding proteins. The compositions of the injection can, as is well known in the art, be formulated so as to provide quick, sustained or delayed release of the active ingredient after administration to the mammal.

The presently disclosed subject matter also provides use of antibodies and nucleic acids that encode them for treatment of a cancer (e.g., multiple myeloma), for diagnostic and prognostic applications as well as use as research tools for the detection of FcRL5 in cells and tissues. Pharmaceutical compositions comprising the disclosed antibodies and nucleic acids are encompassed by the presently disclosed subject matter. Vectors comprising the nucleic acids of the presently disclosed subject matter for antibody-based treatment by vectored immunotherapy are also contemplated by the presently disclosed subject matter. Vectors include expression vectors which enable the expression and secretion of antibodies, as well as vectors which are directed to cell surface expression of the antigen binding proteins, such as chimeric antigen receptors.

In certain embodiments, the nucleic acid sequences encoding the presently disclosed antibodies (provided in Tables 1-228) can be inserted into a vector for expression, e.g., within a cell. Cells comprising such nucleic acids, for example cells that have been transfected with the vectors of the invention, are also encompassed by the presently disclosed subject matter.

Kits

The presently disclosed subject matter provides kits for the treatment or prevention of a cancer (e.g., multiple myeloma). In certain embodiments, the kit comprises a therapeutic composition containing an effective amount of an anti-FcRL5 antibody in unit dosage form. In certain embodiments, the kit can further comprise one or more other agents In certain embodiments, the kit comprises a sterile container which contains a therapeutic composition; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments.

In certain embodiments, the anti-FcRL5 antibody or antigen-binding fragment thereof is provided together with instructions for administration to a subject having or at risk of developing a cancer (e.g., multiple myeloma). The instructions will generally include information about the use of the composition for the treatment or prevention of a cancer (e.g., multiple myeloma). In other embodiments, the instructions include at least one of the following: description of the therapeutic agent; dosage schedule and administration for treatment or prevention of a neoplasia (e.g., multiple myeloma) or symptoms thereof; precautions; warnings; indications; counter-indications; overdosage information; adverse reactions; animal pharmacology; clinical studies; and/or references. The instructions may be printed directly on the container (when present), or as a label applied to the container, or as a separate sheet, pamphlet, card, or folder supplied in or with the container.

Analysis and Production Methods

Flow Cytometry Analysis.

For cell surface staining, cells can be incubated with appropriate mAbs for 30 minutes on ice, washed, and incubated with secondary antibody reagents when necessary. Flow cytometry data can be collected on a FACS Calibur (Becton Dickinson) and analyzed with FlowJo V8.7.1 and 9.4.8 software.

Selection and Characterization of scFvs Specific for FcRL5.

A human scFv antibody phage display library can be used for the selection of mAb clones. In certain embodiments, phage display selection against FcRL5 can be conducted using a cell panning strategy with 31 human scFv naïve and semi-synthetic phage sub-libraries. FcRL5 overexpressing 3T3 cells can be used in positive panning, and FcRL1, 2, 3, 4 and 6 overexpressing 3T3 cells (5 cell lines in total) can be used in negative panning. Bound clones can then be eluted and used to infect E. Coli XL1-Blue. The scFv phage clones expressed in the bacteria can be purified as previously described (Yasmina, et al. Probing the binding mechanism and affinity of tanezumab, a recombinant humanized anti-NGF monoclonal antibody, using a repertoire of biosensors. Protein Science 2008, 17(8):1326-1335; Roberts, et al. Vaccination with CD20 peptides induces a biologically active, specific immune response in mice. Blood 2002, 99(10): 3748-3755). Panning can be performed for about 3 to about 4 cycles to enrich scFv phage clones that bind to FcRL5 specifically. Positive clones can be determined by ELISA method against His-tag FcRL5. Positive clones can be further tested for their binding to FcRL5 on live cell surfaces by flow cytometry, using FcRL5-overexpressing cell lines, e.g., 3T3 and/or Raji cells that overexpress FcRL5. The cells can be washed, and the staining can be performed using the following steps: the cells can be first stained with purified scFv phage clones, and followed by staining with a mouse anti-M13 mAb, and finally the horse anti-mouse Ig's conjugate to PE. Each step of the staining can be done between 30-60 minutes on ice and the cells were washed twice between each step of the staining. In certain embodiments, the positive clones can be further characterized for specific binding to domain 9 of FcRL5 using cells, e.g., 3T3 cells, that overexpress FcRL5 that has a domain 9 deletion (FcRL5Δdom9).

Engineering Full Length mAb Using the Selected ScFv Fragments.

Full-length human IgG of the selected phage clones can be produced in HEK293 and Chinese hamster ovary (CHO) cell lines, as described (Caron P C, Class K, Laird W, Co M S, Queen C, Scheinberg D A. Engineered humanized dimeric forms of IgG are more effective antibodies. J Exp Med 176:1 191-1 195. 1992). In brief, antibody variable regions can be subcloned into mammalian expression vectors, with matching human lambda or kappa light chain constant region and human IgG constant region sequences. Molecular weight of the purified full length IgG antibodies can be measured under both reducing and non-reducing conditions by electrophoresis.

Characterization of the Full-Length Human IgG for FcRL5.

Initially, specificities of the fully human IgG mAbs for the FcRL5 can be determined by staining 3T3 cells transduced to overexpress FcRL5, followed by secondary goat anti-human IgG mAb conjugate to PE or FITC. The fluorescence intensity can be measured by flow cytometry. The same method can be used to determine the binding of the mAbs to fresh tumor cells and cell lines.

Antibody-Dependent Cellular Cytotoxicity (ADCC).

Target cells used for ADCC can be 3T3 cells overexpressing FcRL5. Anti-FcRL5 antibody or its control human IgG at various concentrations can be incubated with target cells and fresh PBMCs at different effector:target (E:T) ratio for 16 hrs. The supernatant can be harvested and the cytotoxicity can be measured by LDH release assay using Cytotox 96 nonradioactive kit from Promega following their instruction. Cytotoxicity can also be measured by standard 4 hours 51 Cr-release assay.

Exemplary Anti-FcRL5 Antibodies

TABLE 1

```
ET200-001
DNA Sequence
(light chain variable region scFv linker heavy chain variable region His tag +
HA tag)
Cagtctgtgttgacgcagccaccctcagcgtctgggaccccgggcagagggtcaccatctcttgttctggaagcag
ctccaacatcggaagtaatactgtaaactggtaccagcagctcccaggaacggcccccaaactcctcatctatagtaat
aatcagcggccctcaggggtccctgaccgattctctggctccaagtctggcacctcagcctccctggccatcagtggg
ctccagtctgaggatgaggctgattattactgtgcagcatgggatgacagcctgaatggttatgtcttcggaactggga
ccaaggtcaccgtcctaggt [SEQ ID NO: 1]
```

TABLE 1-continued

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtcctcacctgcgctgtgt
atggtgggtccttcagtggttactactggagctggatccgccagcccccagggaaggggctggagtggattgg
ggaaatcaatcatagtggaagcaccaactacaacccgtccctcaagagtcgagtcaccatatcagtagacac
gtccaagaaccagttctccctgaagctgagctctgtgaccgccgcggacacggccgtgtattactgtgcgcgcg
aaggtccgtacgacggtttcgattcttggggtcaaggtactctggtgaccgtctcctca** [SEQ ID NO: 2]

ACTAGTGGCCAGGCCGGCCAGCACCATCACCATCACCATGGCGCATAC
CCGTACGACGTTCCGGACTACGCTTCT [SEQ ID NO: 306]

Amino Acid Sequence
(light chain variable region scFv linker heavy chain variable region His tag +
HA tag)
QSVLTQPPSASGTPGQRVTISCSGSSSNIGSNTVNWYQQLPGTAPKLLIYSN
NQRPSGVPDRFSGSKSGTSASLAISGLQSEDEADYYCAAWDDSLNGYVFG
TGTKVTVLG [SEQ ID NO: 3]

<u>SRGGGGSGGGGSGGGGSLEMA</u> [SEQ ID NO: 307]

**QVQLQQWGAGLLKPSETLSLTCAVYGGSFSGYYWSWIRQPPGKGLE
WIGEINHSGSTNYNPSLKSRVTISVDTSKNQFSLKLSSVTAADTAVYYC
AREGPYDGFDSWGQGTLVTVSS** [SEQ ID NO: 4]

TSGQAGQHHHHHHGAYPYDVPDYAS [SEQ ID NO: 308]

TABLE 2

ET200-002
DNA Sequence
(light chain variable region scFv linker heavy chain variable region His tag +
HA tag)
Aattttatgctgactcagccccactctgtgtcggagtctccggggaagacggtaaccatctcctgcacccgcagcagt
ggcagcattgccagcaactatgtgcagtggtaccagcagcgcccgggcagtgcccccaccactgtgatctatgagg
ataaccaaagaccctctggggtccctgatcggttctctggctccatcgacagctcctccaactctgcctccctcaccatc
tctggactgaagactgaggacgaggctgactactactgtcagtcttatgatagcagcaattctgtggtattcggcggag
ggaccaagctgaccgtcctaggt [SEQ ID No. 5]

<u>tctagaggtggtggtggtagcggcggcggcggctctggtggtggtggatccctcgagatggcc</u> [SEQ ID NO: 305]

**caggtccagctggtacagtctggcactgaggtgaagaagcctggggcctcagtgagggtcgcctgcaaggctt
ctggttaccccctttaacaaatatgacatcaactgggtgcgacaggcccctggacaagggcttgagtggatggg
aggcatcatccctatctttcgtacaacaaactacgcacagaagttccagggcagagtcacgattaccgcggac
gaatccacgagcacagcctacatggagctgagcagcctgagatctgaggacacggccgtatattactgtgcgc
gcgaatggttctactgggatatctggggtcaaggtactctggtgaccgtctcctca** [SEQ ID NO: 6]

ACTAGTGGCCAGGCCGGCCAGCACCATCACCATCACCATGGCGCATAC
CCGTACGACGTTCCGGACTACGCTTCT [SEQ ID NO: 306]

Amino Acid Sequence
(light chain variable region scFv linker heavy chain variable region His tag +
HA tag)
NFMLTQPHSVSESPGKTVTISCTRSSGSIASNYVQWYQQRPGSAPTTVIYE
DNQRPSGVPDRFSGSIDSSSNSASLTISGLKTEDEADYYCQSYDSSNSVVFG
GGTKLTVLG [SEQ ID NO: 7]

<u>SRGGGGSGGGGSGGGGSLEMA</u> [SEQ ID NO: 307]

**QVQLVQSGTEVKKPGASVRVACKASGYPFNKYDINWVRQAPGQGLE
WMGGIIPIFRTTNYAQKFQGRVTITADESTSTAYMELSSLRSEDTAVY
YCAREWFYWDIWGQGTLVTVSS** [SEQ ID NO: 8]

TSGQAGQHHHHHHGAYPYDVPDYAS [SEQ ID NO: 308]

TABLE 3

DNA Sequence
(light chain variable region scFv linker heavy chain variable region His tag + HA tag)
cagtctgtgttgactcagccaccctcagtgtccgtgtccccaggacagacagccagcatctcctgctctggaaataaattggggactaagtatgt
ttactggtatcagaagaggccaggccagtcccctgtgttggtcatgtatgaagataatcagcggccctcagggatcccggagcggttctctgg
ctccaactctgggaacacagccactctgaccatcagagggacccagactggatgaggctgactattactgtcaggcgtgggactccgaca
ctttcgtggtcttcggcggagggaccaaggtcaccgtcctaggt [SEQ ID NO: 9]

<u>tctagaggtggtggtggtagcggcggcggcggctctggtggtggtggatccctcgagatggcc</u> [SEQ ID NO: 305]

**gaggtgcagctggtggagaccggggaggcgtggtccagcctggaggtccctgagactctcctgtgcagcctctggattcaccttca
gtagttatggcatgcactgggtccgccaggctccaggcaaggggctggagtgggtggcagttatatacatgatggaagtaataaat
actacgcagactccgtgaagggccgattcaccatctccagagacaattccaaggacacgctgtatctgcaaatgaacagcctgagag
gtgaggacacggccgtatattactgtgcgcgctctaaccagtggtctggttacttctctttcgattactggggtcaaggtactctggtgac
cgtctcctca** [SEQ ID NO: 10]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSVSPGQTASISCSGNKLGTKYVYWYQKRPGQSPVLVMYEDNQRPSGIPER
FSGSNSGNTATLTIRGTQTVDEADYYCQAWDSDTFVVFGGGTKVTVLG [SEQ ID NO: 11]

<u>SRGGGGSGGGGSGGGGSLEMA</u> [SEQ ID NO: 307]

**EVQLVETGGGVVQPGRSLRLSCAASGFTFSSYGMHWVRQAPGKGLEWVAVISHDGS
NKYYADSVKGRFTISRDNSKDTLYLQMNSLRGEDTAVYYCARSNQWSGYFSFDYWG
QGTLVTVSS** [SEQ ID NO: 12]

TSGQAGQHHHHHHGAYPYDVPDYAS [SEQ ID NO: 308]

TABLE 4

ET200-006
DNA Sequence
(light chain variable region scFv linker heavy chain variable region His tag + HA tag)
tcctatgtgctgactcagccaccctcagtgtcagtggccccaggaaagacggccaggattacctgtgggggaaacaacattggaagtaaaag
tgtgcactggtaccagcagaagccaggccaggcccctgtggtggtcatccattatgatagcgaccggccctcagggatccctgagcgattctc
tggctccaactctgggaacacggccaccctgaccatcagcagggtcgaagccggggatgaggccgactattactgtcaggtgtgggatagt
agtagtgatcatccttatgtcttcggaactgggaccaaggtcaccgtcctaggt [SEQ ID NO: 13]

<u>tctagaggtggtggtggtagcggcggcggcggctctggtggtggtggatccctcgagatggcc</u> [SEQ ID NO: 305]

**gaggtgcagctggtgcagtctggagctgaggtgaagaagcctggggcctcagtgaaggtctcctgcaaggcttctggttacacctta
ccacctatggtatcagctgggtgcgacaggcccctggacaagggcttgagtggatgggatggatcaacacttacaatggtcacacaa
atctgacgacactgccgtgtattactgtgcgcgcgttatctacggttctggtgattactggggtcaaggtactctggtgaccgtctcctca**
[SEQ ID NO: 14]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVVVIHYDSDRPSGIPERF
SGSNSGNTATLTISRVEAGDEADYYCQVWDSSSDHPYVFGTGTKVTVLG [SEQ ID NO:
15]

<u>SRGGGGSGGGGSGGGGSLEMA</u> [SEQ ID NO: 307]

**EVQLVQSGAEVKKPGASVKVSCKASGYTFTTYGISWVRQAPGQGLEWMGWINTYN
GHTNYAQKLQGRATMTADTSTNTAYMELRSLRSDDTAVYYCARVIYGSGDYWGQG
TLVTVSS** [SEQ ID NO: 16]

TSGQAGQHHHHHHGAYPYDVPDYAS [SEQ ID NO: 308]

TABLE 5

ET200-007
DNA Sequence
(light chain variable region scFv linker heavy chain variable region His tag + HA tag)
tcctatgtgctgactcagccactctcagtgtcagtggccccaggaaagacggccaggattacctgtgggggaaacaacattggaagtaaaact
gtgcactggtaccagcagaagccaggccaggcccctgtgctggtcatctattatgatagcgaccggcccctcagggatccctgagcgattctct
ggctccaactctgggaacacggccaccctgaccatcagcagggtcgaagccggggatgaggccgactattactgtcaggtgtgggatagta
gtagtgatcatcgggtgttcggcggagggaccaagctgaccgtcctaggt [SEQ ID NO: 17]

<u>tctagaggtggtggtggtagcggcggcggcggctctggtggtggtggatccctcgagatggcc</u> [SEQ ID NO: 305]

**caggtgcagctgcaggagtcgggcccaggactggtgaagccttcggagaccctgtccctcacctgcaatgtctctggttactccatca
gcagtggttactttggggctggatccggcagccccagggaaggggctggagtggattgggagtatctatcatagtaggagcacct
actacaacccgtccctcaagagtcgagtcaccatatcagtagacacgtccaagaaccagttctccctgaagctgaactctgtgaccgc
cgcagacacggccgtgtattactgtgcgcgcggttacggttacttcgattactggggtcaaggtactctggtgaccgtctcctca**
[SEQ ID NO: 18]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPLSVSVAPGKTARITCGGNNIGSKTVHWYQQKPGQAPVLVIYYDSDRPSGIPERF
SGSNSGNTATLTISRVEAGDEADYYCQVWDSSSDHRVFGGGTKLTVLG [SEQ ID NO: 19]

<u>SRGGGGSGGGGSGGGGSLEMA</u> [SEQ ID NO: 307]

**QVQLQESGPGLVKPSETLSLTCNVSGYSISSGYFWGWIRQPPGKGLEWIGSIYHSRST
YYNPSLKSRVTISVDTSKNQFSLKLNSVTAADTAVYYCARGYGYFDYWGQGTLVTVS
S** [SEQ ID NO: 20]

TSGQAGQHHHHHGAYPYDVPDYAS [SEQ ID NO: 308]

TABLE 6

ET200-008
DNA Sequence
(light chain variable region scFv linker heavy chain variable region His tag + HA tag)
caatctgccctgactcagcctgcctccgtgtctgggtctcctggacagtcgatcaccatctcctgcactggaaccagcagtgacgttggtggtta
taactatgtctcctggtaccaacaacacccaggcaaagcccccaaactcatgatttat-
gatgtcagtaatcggccctcaggggtttctaatcgctt
ctctggctccaagtctggcaacacggcctccctgaccatctctgggctcaggctgaggacgaggctgattattactgcagctcatatacaagc
agcagcacttcgaaggtgttcggcggagggaccaagctgaccgtcctaggt [SEQ ID NO: 21]

<u>tctagaggtggtggtggtagcggcggcggcggctctggtggtggtggatccctcgagatggcc</u> [SEQ ID NO: 305]

**gaggtgcagctggtggagtctgggggaggtgtggtacggcctggggggtccctgagactctcctgtgcagcctctggattcaccttg
gtgattatggcatgagctgggtccgccaagctccagggaaggggctggagtgggtctctggtattaattggaatggtggtagcacag
gttatgcagactctgtgaagggccgattcaccatctccagagacaacgccaagaactccctgtatctgcaaatgaacagtctgagagc
cgaggacacggccgtatattactgtgcgcgctctaaatacaacttccatgtttactacgattactggggtcaaggtactctggtgaccgt
ctcctca** [SEQ ID NO: 22]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSALTQPASVSGSPGQSITISCTGTSSDVGGYNYVSWYQQHPGKAPKLMIYDVSNRPSGVS
NRFSGSKSGNTASLTISGLQAEDEADYYCSSYTSSSTSKVFGGGTKLTVLG [SEQ ID NO: 23]

<u>SRGGGGSGGGGSGGGGSLEMA</u> [SEQ ID NO: 307]

**EVQLVESGGGVVRPGGSLRLSCAASGFTFGDYGMSWVRQAPGKGLEWVSGINWNG
GSTGYADSVKGRFTISRDNAKNSLYLQMNSLRAEDTAVYYCARSKYNFHVYYDYWG
QGTLVTVSS** [SEQ ID NO: 24]

TSGQAGQHHHHHGAYPYDVPDYAS [SEQ ID NO: 308]

TABLE 7

ET200-009
DNA Sequence
(light chain variable region scFv linker heavy chain variable region His tag + HA tag)
cagtctgtgttgacgcagccaccctcagcgtctgggaccccgggcagacagtcaccatctcttgttctggaagcaactccaacatcggaagt
aattatgtatactggtaccagcagctcccaggaacggcccccaaactcctcatctataggaataatcagcggccctcaggggtccctgaccga
ttctcaggctccaagtctggcacctcagcctccctggccatcagtgggctccgctccgaggatgaggctgattattactgtgcagcatgggatg
acagcctgagtgcttatgtcttcggaactgggaccaaggtcaccgtcctaggt [SEQ ID NO: 25]

<u>tctagaggtggtggtggtagcggcggcggcggctctggtggtggtggatccctcgagatggcc</u> [SEQ ID NO: 305]

**caggtgcagctggtgcagtctggagctgaggtgaagaagcctggggcctcagtgaaggtctcctgcaaggcttctggttacacccttta
ccagctatggtatcagctgggtgcgacaggcccctggacaagggcttgagtggatgggatggatcagcgcttacaatggtaacacaa
actatgcacagaagctccagggcagagtcaccatgaccacagacacatccacgagcacagcctacatggagctgaggagcctgag
atctgacgacactgccgtgtattactgtgcgcgctcttctggtaacatggtttcttggaaagatatgtgggggtcaaggtactctggtgac
cgtctcctca** [SEQ ID NO: 26]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSASGTPGQTVTISCSGSNSNIGSNYVYWYQQLPGTAPKLLIYRNNQRPSGVPD
RFSGSKSGTSASLAISGLRSEDEADYYCAAWDDSLSAYVFGTGTKVTVLG [SEQ ID NO:
27]

<u>SRGGGGSGGGGSGGGGSLEMA</u> [SEQ ID NO: 307]

**QVQLVQSGAEVKKPGASVKVSCKASGYTFTSYGISWVRQAPGQGLEWMGWISAYN
GNTNYAQKLQGRVTMTTDTSTSTAYMELRSLRSDDTAVYYCARSSGNMVSWKDM
WGQGTLVTVSS** [SEQ ID NO: 28]

TSGQAGQHHHHHHGAYPYDVPDYAS [SEQ ID NO: 308]

TABLE 8

ET200-010
DNA Sequence
(light chain variable region scFv linker heavy chain variable region His tag + HA tag)
caatctgccctgactcagcctgcctccgtgtctgggtctcctggacagtcgatcaccatctcctgcactggaaccagcagtgacgttggtggtta
taactctgtctcctggtaccaacaacacccaggcaaagcccccagactcatgatttat-
gatgtcagtaatcggccctcaggggttttctaatcgctt
ctctggctccaagtctggcaacacggcctcccctgaccatctctgggctccaggctgaggacgaggctgattattactgcagctcatatacaagc
agcagcaccccctttagtcttcggaactgggaccaaggtcaccgtcctaggt [SEQ ID NO: 29]

<u>tctagaggtggtggtggtagcggcggcggcggctctggtggtggtggatccctcgagatggcc</u> [SEQ ID NO: 305]

**caggtgcagctggtgcagtctggggctgaggtgaagaagcctggggcctcagtgaaggtctcctgcaaggcttctggttacacccttta
ccagctatggtatcagctgggtgcgacaggcccctggacaagggcttgagtggatgggatggatcagcgcttacaatggtaacacaa
actatgcacagaagctccagggcagagtcaccatgaccacagacacatccacgagcacagcctacatggagctgaggagcctgag
atctgacgacacggccgtgtattactgtgcgcgcggtgctgttgcttaccatgattggggtcaaggtactctggtgaccgtctcctca**
[SEQ ID NO: 30]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSALTQPASVSGSPGQSITISCTGTSSDVGGYNSVSWYQQHPGKAPRLMIYDVSNRPSGVS
NRFSGSKSGNTASLTISGLQAEDEADYYCSSYTSSSTPLVFGTGTKVTVLG [SEQ ID NO:
31]

<u>SRGGGGSGGGGSGGGGSLEMA</u> [SEQ ID NO: 307]

**QVQLVQSGAEVKKPGASVKVSCKASGYTFTSYGISWVRQAPGQGLEWMGWISAYN
GNTNYAQKLQGRVTMTTDTSTSTAYMELRSLRSDDTAVYYCARGAVAYHDWGQGT
LVTVSS** [SEQ ID NO: 32]

TSGQAGQHHHHHHGAYPYDVPDYAS [SEQ ID NO: 308]

TABLE 9

ET200-011
DNA Sequence
(light chain variable region scFv linker heavy chain variable region His tag + HA tag)
cagtctgtcgtgacgcagccgcccctcagtgtctgcggccccaggacagagggtcaccatctcctgctctggaagcagctccaacatttcgatttatgatgtatcctggtatcagcagctcccaggaacagcccccaaactcctcatttatggcaataataagcgaccctcggggattgctgaccgattctctggctccacgtctggcacgtcagccaccctgggcatcaccggactccagactggggacgaggccgattattactgcggaacatgggatgacagtctgagtggggggggtgttcggcggagggaccaagctgaccgtcctaggt [SEQ ID NO: 33]

<u>tctagaggtggtggtggtagcggcggcggcggctctggtggtggtggatccctcgagatggcc</u> [SEQ ID NO: 305]

cagatgcagctggtgcaatctggggctgaggtgaagaagcctgggtcctcggtgaaggtctcctgcgaggcttctggaggcaccctcagcagctatgctatcaactgggtgcgacaggcccctggacaagggcttgagtggatggggggatcatccctatgtttggtacagcacactacgcacagaagttccagggcagagtcacgattaccgcggacgaatccacgaaaacagcctacatggagctgagcagcctgagatctgaggacactgccgtgtattactgtgcgcgcggtgttcattacgcttctttcgatcattgggggtcaaggtactctggtgaccgtctcctca [SEQ ID NO: 34]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSAAPGQRVTISCSGSSSNISIYDVSWYQQLPGTAPKLLIYGNNKRPSGIADR
FSGSTSGTSATLGITGLQTGDEADYYCGTWDDSLSGGVFGGGTKLTVLG [SEQ ID NO: 35]

<u>SRGGGGSGGGGSGGGGSLEMA</u> [SEQ ID NO: 307]

**QMQLVQSGAEVKKPGSSVKVSCEASGGTLSSYAINWVRQAPGQGLEWMGGIIPMFG
TAHYAQKFQGRVTITADESTKTAYMELSSLRSEDTAVYYCARGVHYASFDHWGQGT
LVTVSS** [SEQ ID NO: 36]

TSGQAGQHHHHHGAYPYDVPDYAS [SEQ ID NO: 308]

TABLE 10

ET200-012
DNA Sequence
(light chain variable region scFv linker heavy chain variable region His tag + HA tag)
cagtctgtgttgacgcagccgcccctcagtgtctgcggccgcaggacagaaggtcaccatctcctgctctggaagcgactccaacattgggaataatttatgtgtcctggtatcaacacctcccagggacagccccaaactcctcatt-
tatgacgttaaaaatcgaccctcagggattcctgaccggttc
tccggctccaagtctggctcgtcagccaccctaggcatcgccggactccagcctggggacgaggccgattattactgcggaacatgggacagtcggctggatgcctatgtcttcggaactgggaccaaggtcaccgtcctaggt [SEQ ID NO: 37]

<u>tctagaggtggtggtggtagcggcggcggcggctctggtggtggtggatccctcgagatggcc</u> [SEQ ID NO: 305]

cagatgcagctggtgcaatctggagctgaggtgaagaagcctggggcctcagtgaaggtctcctgcaagacttctggtttcccctttaatatctttggaatcacctgggtgcgacaggcccctggacaaggggcttgagtggatgggatggatcagcggttacaacggtaacacagactacccacagaagttccagggcagagtcaccatgtccacagacacatccacgagtacagcctacatggagctgaggaacctgaaatctgacgacacggccgtgtattactgtgcgcgcggtgcttacggtggtatggatacttggggtcaaggtactctggtgaccgtctcctca
[SEQ ID NO: 38]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSAAAGQKVTISCSGSDSNIGNNYVSWYQHLPGTAPKLLIYDVKNRPSGIPD
RFSGSKSGSSATLGIAGLQPGDEADYYCGTWDSRLDAYVFGTGTKVTVLG [SEQ ID NO:
39]

<u>SRGGGGSGGGGSGGGGSLEMA</u> [SEQ ID NO: 307]

**QMQLVQSGAEVKKPGASVKVSCKTSGFPFNIFGITWVRQAPGQGLEWMGWISGYN
GNTDYPQKFQGRVTMSTDTSTSTAYMELRNLKSDDTAVYYCARGAYGGMDTWGQ
GTLVTVSS** [SEQ ID NO: 40]

TSGQAGQHHHHHGAYPYDVPDYAS [SEQ ID NO: 308]

TABLE 11

ET200-013
DNA Sequence
(light chain variable region scFv linker heavy chain variable region His tag + HA tag)
cagtctgtcgtgacgcagccgccctcagtgtctggggccccagggcagagggtcaccatctcctgcactgggagcacctccaacatcggggg
caggttatgatgtacactggtatcagcagcttccaggaacagccccaaactcctcatctatactaacaactttcggcccctcaggggtccctgac
cgattctctgcctccaagtctggcacttcagcttccctggccatcactggtctccaggctgaggatgaggctgattattactgcggaacatggga
tagcagcctgagtgccgttgtgttcggcggagggaccaagctgaccgtcctaggt [SEQ ID NO: 41]

<u>tctagaggtggtggtggtagcggcggcggcggctctggtggtggtggatccctcgagatggcc</u> [SEQ ID NO: 305]

gaggtgcagctggtggagtctggaactgaggtgaagaagcctggggcctcagtgaaagtctcctgcaaggcttctggttacatgtttta
ccagttatggtctcaactgggtgcgacaggcccctggacaagggcttgagtggatgggatggatcagcgctaacaatggtaagacaa
attatgctaagaaattccaggacagagtcaccatgaccagagacacttccacgagcacaggctacatggaactgaggagcctgaga
tctgacgacacggccgtatattactgtgcgcgccatatcggtggttcttacttcgatcgttggggtcaaggtactctggtgaccgtctcct
ca [SEQ ID NO: 42]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSGAPGQRVTISCTGSTSNIGAGYDVHWYQQLPGTAPKLLIYTNNFRPSGVP
DRFSASKSGTSASLAITGLQAEDEADYYCGTWDSSLSAVVFGGGTKLTVLG [SEQ ID NO: 43]

<u>SRGGGGSGGGGSGGGGSLEMA</u> [SEQ ID NO: 307]

EVQLVESGTEVKKPGASVKVSCKASGYMFTSYGLNWVRQAPGQGLEWMGWISANN
GKTNYAKKFQDRVTMTRDTSTSTGYMELRSLRSDDTAVYYCARHIGGSYFDRWGQ
GTLVTVSS [SEQ ID NO: 44]

TSGQAGQHHHHHGAYPYDVPDYAS [SEQ ID NO: 308]

TABLE 12

ET200-014
DNA Sequence
(light chain variable region scFv linker heavy chain variable region His tag + HA tag)
tcctatgtgctgactcagccaccctcagtgtcagtggccccaggaaagacggccaggattacctgtgggggaaacaacattggaagtaaaag
tgtgcactggtaccagcagaagccaggccaggcccctgtgctggtcatctattatgatagcgaccggccctcagggatccctgagcgattctc
tggctccaactctgggaacacggccaccctgaccatcagcagggtcgaagccggggatgaggccgactattactgtcaggtgtgggatagt
agtagtgatcattatgtcttcggaactgggaccaaggtcaccgtcctaggt [SEQ ID NO: 45]

<u>tctagaggtggtggtggtagcggcggcggcggctctggtggtggtggatccctcgagatggcc</u> [SEQ ID NO: 305]

gaggtgcagctggtggagactggggggaggcttggtacagcctggggggtccctgagactctcctgtgcagcctctggattcacctttta
gcagctatgccatgagctgggtccgccaggctccagggaaggggctggagtgggtctcagctattagtggtagtgatggtagcacat
actacgcagactccgtgaagggccggttcaccatctccagagacaattccaagaacacgctgtatctgcaaatgaacagcctgagag
acgaggacacggccgtatattactgtgcgcgctctcatgaagctaacctggttggtgattggtgggtcaaggtactctggtgaccgtc
tcctca [SEQ ID NO: 46]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVIYYDSDRPSGIPERF
SGSNSGNTATLTISRVEAGDEADYYCQVWDSSSDHYVFGTGTKVTVLG [SEQ ID NO: 47]

<u>SRGGGGSGGGGSGGGGSLEMA</u> [SEQ ID NO: 307]

EVQLVETGGGLVQPGGSLRLSCAASGFTFSSYAMSWVRQAPGKGLEWVSAISGSDG
STYYADSVKGRFTISRDNSKNTLYLQMNSLRDEDTAVYYCARSHEANLVGDWWGQ
GTLVTVSS [SEQ ID NO: 48]

TSGQAGQHHHHHGAYPYDVPDYAS [SEQ ID NO: 308]

TABLE 13

ET200-015
DNA Sequence
(light chain variable region scFv linker heavy chain variable region His tag + HA tag)
cagtctgtggtgactcagccaccctcagtgtcagtggccccaggaaagacggccaggattacctgtgggggaaacaacattggaagtaaaa
gtgtgcactggtaccagcagaagccaggccaggccccctgtgctggtcatctattatgatagcgaccggccctcagggatccctgagcgattct
ctggctccaactctgggaacacggccaccctgaccatcagcagggtcgaagccggggatgaggccgactattactgtcaggtgtgggatag
tagtagtgatgtggtattcggcggagggaccaagctgaccgtcctaggt [SEQ ID NO: 49]

<u>tctagaggtggtggtggtagcggcggcggcggctctggtggtggtggatccctcgagatggcc</u> [SEQ ID NO: 305]

**gaggtccagctggtacagtctggagctgaggtgaagaagcctggggcctcagtgaaggtctcctgcaaggcttctggttacacccttta
ccagctacggtatcagctgggtgcgacaggccccctggacaagggcttgagtggatgggatggatcagcgcttacaatggtaacaca
aactatgcacagaagctccagggcagagtcaccatgaccacagacacatccacgagcacagcctacatggagctgaggagcctga
gatctgacgacacggccgtgtattactgtgcgcgctggggtggtttcggtgctgttgatcattgggggtcaaggtactctggtgaccgtct
cctca** [SEQ ID NO: 50]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSVAPGKTARITCGGNNIGSKSVHWYQQKPGQAPVLVIYYDSDRPSGIPERF
SGSNSGNTATLTISRVEAGDEADYYCQVWDSSSDVVFGGGTKLTVLG [SEQ ID NO: 51]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGWISAYN
GNTNYAQKLQGRVTMTTDTSTSTAYMELRSLRSDDTAVYYCARWGGFGAVDHWG
QGTLVTVSS** [SEQ ID NO: 52]

TSGQAGQHHHHHGAYPYDVPDYAS [SEQ ID NO: 308]

TABLE 14

ET200-016
DNA Sequence
(light chain variable region scFv linker heavy chain variable region His tag + HA tag)
tcttctgagctgactcaggaccctgctgtgtctgtggccttgggacagacagtcaagatcacgtgccaaggagacagcctcacagactaccat
gcaacctggtaccagcagaagccaggacaggcccctgtcgctgtcatctatgctacaaacaaccggcccactgggatcccagaccgattctc
tggttccagttccggaaacacagcttctttgaccatcactggggctcaggcggaagatgaggctgactattactgtaattcccgggacagcggc
acggacgaagtgttattcggcggagggaccaagctgaccgtcctaggt [SEQ ID NO: 53]

<u>tctagaggtggtggtggtagcggcggcggcggctctggtggtggtggatccctcgagatggcc</u> [SEQ ID NO: 305]

**gaggtgcagctggtggagactggggggaggcctggtcaagcctggggggtccctgagactctcctgtgcagcctctggattcaccttca
gtagctatagcatgaactgggtccgccaggctccagggaaggggctggagtgggtctcatccattagtagtagtagtagttacatata
ctacgcagactcagtgaagggccgattcaccatctccagagacaacgccaagaactcactgtatctgcaaatgaacagcctgagag
ccgaggacacggccgtgtattactgtgcgcgcggtcagggttacgattactggggtcaaggtactctggtgaccgtctcctca** [SEQ
ID NO: 54]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SSELTQDPAVSVALGQTVKITCQGDSLTDYHATWYQQKPGQAPVAVIYATNNRPTGIPDR
FSGSSSGNTASLTITGAQAEDEADYYCNSRDSGTDEVLFGGGTKLTVLG [SEQ ID NO: 55]

<u>SRGGGGSGGGGSGGGGSLEMA</u> [SEQ ID NO: 307]

**EVQLVETGGGLVKPGGSLRLSCAASGFTFSSYSMNWVRQAPGKGLEWVSSISSSSSYI
YYADSVKGRFTISRDNAKNSLYLQMNSLRAEDTAVYYCARGQGYDYWGQGTLVTV
SS** [SEQ ID NO: 56]

TSGQAGQHHHHHGAYPYDVPDYAS [SEQ ID NO: 308]

TABLE 15

ET200-017
DNA Sequence
(light chain variable region scFv linker heavy chain variable region His tag + HA tag)
tcctatgtgctgactcagccaccctcggtgtcagtggccccaggaaagacggccaggattacctgtgggggaaacaacattggaagtaaaag
tgtgcactggtaccagcagaagccaggccaggcccctgtgctggtcgtctatgatgatagcgaccggccctcagggatccctgagcgattct
ctggctccaactctgggaacacggccaccctgagcatcagcagggtcgaagccggggatgaggccgactattactgtcaggtgtgggatag
tagtagtgatcatactgtcttcggaactgggaccaaggtcaccgtcctaggt [SEQ ID NO: 57]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtccctcacctgcgctgtctatggtgggtccttca
gtggttactactggagctggatccgccagcccccaggaaggggctggagtggattgggaaatcaatcatagtggaagcaccaac
tacaacccgtccctcaagagtcgagtcaccatatcagtagacacgtccaagaaccagttctccctgaagctgagctctgtgaccgccg
cggacacggccgtgtattactgtgcgcgctactacccgggtatggatatgtggggtcaaggtactctggtgaccgtctcctca** [SEQ
ID NO: 58]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVVYDDSDRPSGIPER
FSGSNSGNTATLSISRVEAGDEADYYCQVWDSSSDHTVFGTGTKVTVLG [SEQ ID NO: 59]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEINHSGS
TNYNPSLKSRVTISVDTSKNQFSLKLSSVTAADTAVYYCARYYPGMDMWGQGTLVT
VSS** [SEQ ID NO: 60]

TSGQAGQHHHHHHGAYPYDVPDYAS [SEQ ID NO: 308]

TABLE 16

ET200-018
DNA Sequence
(light chain variable region scFv linker heavy chain variable region His tag + HA tag)
caggctgtgctgactcagccgccctcaacgtctgggaccccggcagagggtcaccatctcttgttctggaagcagctccaacatcgggag
aaatggtgtaaactggtaccagcagctcccaggagcggcccccaaagtcctcatctataatgataatcagcgaccctcaggggtccctgacc
gagtctctggctcccagtctggctcctcaggcaccctggccatcgatgggcttcggtctgaggatgaggctgattattactgtgcggcatggga
tgacagcctgcatgtgtggtattcggcggagggaccaagctgaccgtcctaggt [SEQ ID NO: 61]

<u>tctagaggtggtggtggtagcggcggcggcggctctggtggtggtggatccctcgagatggcc</u> [SEQ ID NO: 305]

**caggtccagctggtacagtctggggctgaggtgaagaagcctggggcctcagtgaaggtctcctgcaaggtttccggatacaccctc
aatgaattatccatgcactgggtgcgacaggctcctggaaaaggggcttgagtggatggggaggttttgatcctgaagatggtgaaaca
atctacgcacagaagttccagggcagagtcaccatgaccgaggacacatctacagacacagcctacatggagctgagcagcctgag
atctgaggacactgccgtgtattactgtgcgcgcggtggttacggtgattcttggggtcaaggtactctggtgaccgtctcctca** [SEQ
ID NO: 62]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSTSGTPGQRVTISCSGSSSNIGRNGVNWYQQLPGAAPKVLIYNDNQRPSGVPD
RVSGSQSGSSGTLAIDGLRSEDEADYYCAAWDDSLHGVVFGGGTKLTVLG [SEQ ID NO:
63]

<u>SRGGGGSGGGGSGGGGSLEMA</u> [SEQ ID NO: 307]

**QVQLVQSGAEVKKPGASVKVSCKVSGYTLNELSMHWVRQAPGKGLEWMGGFDPE
DGETIYAQKFQGRVTMTEDTSTDTAYMELSSLRSEDTAVYYCARGGYGDSWGQGTL
VTVSS** [SEQ ID NO: 64]

TSGQAGQHHHHHHGAYPYDVPDYAS [SEQ ID NO: 308]

TABLE 17

ET200-019
DNA Sequence
(light chain variable region scFv linker heavy chain variable region His tag + HA tag)
aatttttatgctgactcagccccactctgtgtcggagtctccggggaagacggtaaccatctcctgcacccgcagcagtggcagcattgccagc
aactatgtgcagtggtaccagcagcgcccgggcagtgccccactgtgatctatgaggataaccaaagaccctctggggtccctgatcg
gttctctggctccatcgacagctcctccaactctgcctccctcaccatctctggactgaa-
gactgaggacgaggctgactactactgtcagtctta
tgatagcagcaattcttgggtgttcggcggagggaccaagctgaccgtcctaggt [SEQ ID NO: 65]

tctagaggtggtggtggtagcggcggcggcggctctggtggtggtggatccctcgagatggcc [SEQ ID NO: 305]

caggtgcagctggtgcaatctggggctgaggtgaagaggcctggggtcctcggtgaaggtctcctgcacggcttctggaggcaccttca
gcagcgatgctatcagctgggtgcgacaggcccctggacaagggcttgagtggatgggaggaatcatccctatgtttggtacagcaa
actacgcacagaagttccagggcagagtcacgattaccgcggacgaatccacgagcacagcctacatggagctgagcagcctgag
atctgaggacacggccgtgtattactgtgcgcgcgaaggttactactaccgtctgcttacctgggttctgttctgaacgacatctcttct
gtttacgatgaatggggtcaaggtactctggtgaccgtctcctca [SEQ ID NO: 66]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSAPTTVIYEDNQRPSGVPD
RFSGSIDSSSNSASLTISGLKTEDEADYYCQSYDSSNSWVFGGGTKLTVLG [SEQ ID NO:
67]

SRGGGGSGGGGSGGGGSLEMA [SEQ ID NO: 307]

**QVQLVQSGAEVKRPGSSVKVSCTASGGTFSSDAISWVRQAPGQGLEWMGGIIPMFG
TANYAQKFQGRVTITADESTSTAYMELSSLRSEDTAVYYCAREGYYYPSAYLGSVLN
DISSVYDEWGQGTLVTVSS** [SEQ ID NO: 68]

TSGQAGQHHHHHHGAYPYDVPDYAS [SEQ ID NO: 308]

TABLE 18

ET200-020
DNA Sequence
(light chain variable region scFv linker heavy chain variable region His tag + HA tag)
cagtctctgtcgtgacgcagccgccctcagtgtctgcggcccaggacagaaggtcaccatctcctgctctggaagcacctccaacattgaaat
aatgatgtatcctggtaccagcagctcccaggaacagccccaaactcctcatttatgacaataataagcgaccctcagggattcctgaccgatt
ctctggctccaagtctggcacgtcagccaccctgggcatcaccggactccagactggggacgaggccgattattactgcggaacatgggata
gcagcgtgagtgcttcttgggtcttcggcagagggaccaagctgaccgtcctaggt [SEQ ID NO: 69]

tctagaggtggtggtggtagcggcggcggcggctctggtggtggtggatccctcgagatggcc [SEQ ID NO: 305]

caggtgcagctggtgcagtctggagctgaggtgaagaagcctggggcctcagtgaaggtctcctgcaaggcttctggttacacctttta
ccagctatggtatcagctgggtgcgacaggcccctggacaagggcttgagtggatgggatggatcagcgcttacaatggtaacacaa
actatccacagaagctccaggggcagagtcaccatgaccacagacccatccacgagcacagcctacatggagctgaggagcctgag
atctgacgacacggccgtgtattactgtgcgcgctctatgacttctttcgattactggggtcaaggtactctggtgaccgtctcctca
[SEQ ID NO: 70]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSAAPGQKVTISCSGSTSNIGNNDVSWYQQLPGTAPKLLIYDNNKRPSGIPD
RFSGSKSGTSATLGITGLQTGDEADYYCGTWDSSVSASWVFGRGTKLTVLG [SEQ ID NO:
71]

SRGGGGSGGGGSGGGGSLEMA [SEQ ID NO: 307]

**QVQLVQSGAEVKKPGASVKVSCKASGYTFTSYGISWVRQAPGQGLEWMGWISAYN
GNTNYPQKLQGRVTMTTDPSTSTAYMELRSLRSDDTAVYYCARSMTSFDYWGQGT
LVTVSS** [SEQ ID NO: 72]

TSGQAGQHHHHHHGAYPYDVPDYAS [SEQ ID NO: 308]

TABLE 19

ET200-021
DNA Sequence
(light chain variable region scFv linker heavy chain variable region His tag + HA tag)
cagtctgtgttgacgcagccgccctcagtgtctgcggccccaggacagaaggtcaccatctcctgctctggaagcaactccaacattgggaat
aattatgtatcctggtatcagcaactcccagggacagccccaaactcctcatttatgacaataataagcgaccctcagggattcctgaccgatt
ctctggctccaggtctggcacgtcagccaccctgggcatcaccggactccagactggggacgaggccgattattactgcggaacatggaata
ccactgtgactcctggctatgtcttcggaactgggaccaaggtcaccgtcctaggt [SEQ ID NO: 73]

<u>tctagaggtggtggtggtagcggcggcggcggctctggtggtggtggatccctcgagatggcc</u> [SEQ ID NO: 305]

**gaagtgcagctggtgcagtctggagctgaggtgaagaagcctggggcctcagtgaaggtctcctgcaaggcttctggttacacccttta
ccagctatggtatcagctgggtgcgacaggcccctggacaagggcttgagtggatgggatggatcagcgcttacaatggtaacaca
actatgcacagaagctccagggcagagtcaccatgaccacagacacatccacgagcacagcctacatggagctgaggagcctgag
atctgacgacaccgccatgtattactgtgcgcgctctgtttacgacctggatacttggggtcaaggtactctggtgaccgtctcctca**
[SEQ ID NO: 74]

<u>ACTAGTGGCCAGGCCGGCCAGCACCATCACCATCACCATGGCGCATACCCGTACGAC
GTTCCGGACTACGCTTCT</u> [SEQ ID NO: 306]

Amino Acid Sequence
(light chain variable region scFv linker heavy chain variable region His tag + HA tag)
QSVLTQPPSVSAAPGQKVTISCSGSNSNIGNNYVSWYQQLPGTAPKLLIYDNNKRPSGIPD
RFSGSRSGTSATLGITGLQTGDEADYYCGTWNTTVTPGYVFGTGTKVTVLG [SEQ ID NO:
75]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGWISAYN
GNTNYAQKLQGRVTMTTDTSTSTAYMELRSLRSDDTAMYYCARSVYDLDTWGQGT
LVTVSS** [SEQ ID NO: 76]

TSGQAGQHHHHHGAYPYDVPDYAS [SEQ ID NO: 308]

TABLE 20

ET200-022
DNA Sequence
(light chain variable region scFv linker heavy chain variable region His tag + HA tag)
cagtctgtcgtgacgcagccgccctcagtgtctgcggccccaggacagaaggtcaccatctcctgctctggaagcagctccaacattgggaa
taattatgtatcctggtaccagcagctcccaggaacagcccccaaactcctcatttatgacaataataagcgaccctcagggattcctgaccgat
tctctggctccaagtctggcacgtcagccaccctgggcatcaccggactccagactggggacgaggccgattattactgcggaacatgggat
agcagcctggggggccccttatgtcttcggaactgggaccaaggtcaccgtcctaggt [SEQ ID NO: 77]

<u>tctagaggtggtggtggtagcggcggcggcggctctggtggtggtggatccctcgagatggcc</u> [SEQ ID NO: 305]

**gaggtgcagctggtgcagtcttggggaggctcggaacagcctggcaggtccctgagactctcctgtgcagcctctggattcacctttga
tgattatgccatgcactgggtccggcaagctccaggaagggcctggagtgggtctcaggtattagttggaatagcggtagcatagg
ctatgcggactctgtgaagggccgattcaccatctccagagacaacgccaagaattccctgtatctgcaaatgaacagtctgagagct
gaggacaccgccatgtattactgtgcgcgctaccgtcaggttggttctgcttacgattcttggggtcaaggtactctggtgaccgtctcct
ca** [SEQ ID NO: 78]

<u>ACTAGTGGCCAGGCCGGCCAGCACCATCACCATCACCATGGCGCATACCCGTACGAC
GTTCCGGACTACGCTTCT</u> [SEQ ID NO: 306]

Amino Acid Sequence
(light chain variable region scFv linker heavy chain variable region His tag + HA tag)
QSVVTQPPSVSAAPGQKVTISCSGSSSNIGNNYVSWYQQLPGTAPKLLIYDNNKRPSGIPD
RFSGSKSGTSATLGITGLQTGDEADYYCGTWDSSLGAPYVFGTGTKVTVLG [SEQ ID NO:
79]

<u>SRGGGGSGGGGSGGGGSLEMA</u> [SEQ ID NO: 307]

**EVQLVQSWGGSEQPGRSLRLSCAASGFTFDDYAMHWVRQAPGKGLEWVSGISWNS
GSIGYADSVKGRFTISRDNAKNSLYLQMNSLRAEDTAMYYCARYRQVGSAYDSWGQ
GTLVTVSS** [SEQ ID NO: 80]

TSGQAGQHHHHHGAYPYDVPDYAS [SEQ ID NO: 308]

TABLE 21

ET200-023
DNA Sequence
(light chain variable region scFv linker heavy chain variable region His tag + HA tag)
ctgcctgtgctgactcagccaccctcggtgtcagtggccccaggaaagacggccaggattacctgtgggggaaacaacattggaagtaaaa
gtgtgcactggtatcagcagaagccaggccaggcccctgtgctggtcgtctatgctgatagcgaccggccctcagggatccctgagcgattct
ctggctccaactctgggaacacggccaccctgaccatcagcagggtcgaagccggggatgaggccgactattactgtcaggtgtgggatag
tagtagttatcataattatgtcttcggaactgggaccaaggtcaccgtcctaggt [SEQ ID NO: 81]

<u>tctagaggtggtggtggtagcggcggcggcggctctggtggtggtggatccctcgagatggcc</u> [SEQ ID NO: 305]

**gaggtgcagctggtgcagtctggagctgaggtgaagaagcctggggcctcagtgaaggtctcctgcaaggcttctggttacacccttta
ccagctatggtatcagctgggtgcgacaggcccctggacaagggcttgagtggatgggatggatcagcgcttacaatggtaacacaa
actatgcacagaagctccagggcagagtcaccatgaccacagacacatccacgagcacagcctacatggagctgagcagcctgag
atctgaggacaccgccatgtattactgtgcgcgctactggggtttcggtgtttctgatcgttggggtcaaggtactctggtgaccgtctcc
tca** [SEQ ID NO: 82]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
LPVLTQPPSVSVAPGKTARITCGGNNIGSKSVHWYQQKPGQAPVLVVYADSDRPSGIPERF
SGSNSGNTATLTISRVEAGDEADYYCQVWDSSSYHNYVFGTGTKVTVLG [SEQ ID NO:
83]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGWISAYN
GNTNYAQKLQGRVTMTTDTSTSTAYMELSSLRSEDTAMYYCARYWGFGVSDRWGQ
GTLVTVSS** [SEQ ID NO: 84]

TSGQAGQHHHHHGAYPYDVPDYAS [SEQ ID NO: 308]

TABLE 22

ET200-024
DNA Sequence
(light chain variable region scFv linker heavy chain variable region His tag + HA tag)
aattttatgctgactcagccccactctgtgtcggagtctccggggaagacggtaaccatctcctgcaccggcagcagtggcagcattgccagc
aactatgtgcagtggtaccagcagcgcccgggcagtgcccccaccactgtgatctatgaggataaccaaagaccctctgggtccccgatcg
gttctctggctccatcgacagctcctccaactctgcctcctcaccatctctggactgaagactgaggacgaggctgactactactgtcagtctta
tgacagcagcaatctttgggtgttcggcggagggaccaagctgaccgtcctaggt [SEQ ID NO: 85]

<u>tctagaggtggtggtggtagcggcggcggcggctctggtggtggtggatccctcgagatggcc</u> [SEQ ID NO: 305]

**cagatgcagctggtgcagtctggggctgaggtgaagaagcctgggtcctcggtgaaggtctcctgcaaggcttctggaggcaccttca
gcagctatgctatcagctgggtgcgacaggcccctggacaagggcttgagtggatgggagggatcatccctatctttggtacagcaa
actacgcacagaagttccagggcagagtcacgattaccgcggacgaatccacgagcacagcctacatggagctgagcagcctgag
atctgaggacactgccgtgtattactgtgcgcgctacaactactactactacgattcttggggtcaaggtactctggtgaccgtctcctc
a** [SEQ ID NO: 86]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSGSIASNYVQWYQQRPGSAPTTVIYEDNQRPSGVPD
RFSGSIDSSSNSASLTISGLKTEDEADYYCQSYDSSNLWVFGGGTKLTVLG [SEQ ID NO:
87]

<u>SRGGGGSGGGGSGGGGSLEMA</u> [SEQ ID NO: 307]

**QMQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARYNYYYYDSWGQGTLV
TVSS** [SEQ ID NO: 88]

TSGQAGQHHHHHGAYPYDVPDYAS [SEQ ID NO: 308]

TABLE 23

ET200-025
DNA Sequence
(light chain variable region scFv linker heavy chain variable region His tag + HA tag)
gacatccagatgacccagtctccatcctccctgtctgcatctgtaggacagagtcaccatcacttgccgggcaagtcagagcattagcagct
atttaaattggtatcagcagaaaccagggaaagcccctaagctcctgatctatgctgcatccagtttgcaaagtggggtcccatcaaggttcagt
ggcagtggatctgggacagatttcactctcaccatcagcagtctgcaacctgaagattttgcaacttactactgtcaacagagttacagtacccc
attcactttcggccctgggaccaaagtggatatcaaacgt [SEQ ID NO: 89]

<u>tctagaggtggtggtggtagcggcggcggcggctctggtggtggtggatccctcgagatggcc</u> [SEQ ID NO: 305]

**gaggtgcagctggtgcagtctggggctgaggtgaagaagcctggggtcctcggtgaaggtctcctgcaaggcttctggaggcaccttc
agcagctatgctatcagctgggtgcgacaggcccctggacaagggcttgagtggatgggagggatcatccctatctttggtacagca
aactacgcacagaagttccagggcagagtcacgattaccgcggacgaatccacgagcacagcctacatggagctgagcagcctga
gatctgaggacaccgccatgtattactgtgcgcgctactgggggttacgactcttacgatgaatggggtcaaggtactctggtgaccgtc
tcctca** [SEQ ID NO: 90]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
DIQMTQSPSSLSASVGDRVTITCRASQSISSYLNWYQQKPGKAPKLLIYAASSLQSGVPSRF
SGSGSGTDFTLTISSLQPEDFATYYCQQSYSTPFTFGPGTKVDIKR [SEQ ID NO: 91]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGIIPIFGT
ANYAQKFQGRVTITADESTSTAYMELSSLRSEDTAMYYCARYWGYDSYDEWGQGT
LVTVSS** [SEQ ID NO: 92]

TSGQAGQHHHHHGAYPYDVPDYAS [SEQ ID NO: 308]

TABLE 24

ET200-026
DNA Sequence
(light chain variable region scFv linker heavy chain variable region His tag + HA tag)
aattttatgctgactcagccccactctgtgtcggagtctccggggaagacggtaaccatctcctgcaccggcagcagtggcagcattgccagc
aactatgtgcagtggtaccagcagcgcccgggcagtgcccccaccactgtgatctatgaggataaccaaagaccctctggggtccctgatcg
gttctctggctccatcgacagctcctccaactctgcctcctcaccatctctggactgaagactgaggacgaggctgactactactgtcagtctta
tgatagcagcaattgggtgttcggcggagggaccaagctgaccgtcctaggt [SEQ ID NO: 93]

<u>tctagaggtggtggtggtagcggcggcggcggctctggtggtggtggatccctcgagatggcc</u> [SEQ ID NO: 305]

**gaggtccagctggtgcagtctggggctgaggtgaagaagcctggggtcctcggtgaaggtctcctgcaaggcttctggaggcaccttca
gcagctatgctatcagctgggtgcgacaggcccctggacaagggcttgagtggatgggagggatcatccctatctttggtacagcaa
actacgcacagaagttccagggcagagtcacgattaccgcggacgaatccacgagcacagcctacatggagctgagcagcctgag
atctgaggacacggccgtgtattactgtgcgcgcaacaaccattactacaacgattactggggtcaaggtactctggtgaccgtctcct
ca** [SEQ ID NO: 94]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSGSIASNYVQWYQQRPGSAPTTVIYEDNQRPSGVPD
RFSGSIDSSSNSASLTISGLKTEDEADYYCQSYDSSNWVFGGGTKLTVLG [SEQ ID NO: 95]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARNNHYYNDYWGQGTLV
TVSS** [SEQ ID NO: 96]

TSGQAGQHHHHHGAYPYDVPDYAS [SEQ ID NO: 308]

TABLE 25

ET200-027
DNA Sequence
(light chain variable region scFv linker heavy chain variable region His tag + HA tag)
cagtctgtgttgacgcagccgccctcagtgtctggggccccagggcaggggtcaccatcccctgcactgggagcagctccaacatcgggg
caggttatgatgtacactggtaccagcagcttccagggacagcccccaaactcctcatctatggtaacaacaatcggccctcaggggtccctg
accgcttctctggctccaggtctggctcctcagcctccctggccatcactgggctccaggctgaggatgaggctgattattactgccagtcctat
gacagcagcctgagtgatgtggtattcggcggagggaccaaggtcaccgtcctaggt [SEQ ID NO: 97]

tctagaggtggtggtggtagcggcggcggcggctctggtggtggtggatccctcgagatggcc [SEQ ID NO: 305]

gaggtccagctggtgcagtctggggctgaggtgaagaagcctggggctacagtgaaaatctcctgcaaggtttctggatacaccttca
ccgactactacatgcactgggtgcaacaggcccctggaaaagggcttgagtggatgggacttgttgatcctgaagatggtgaaacaa
tatacgcagagaagttccagggcagagtcaccataaccgcggacacgtctacagacacagcctacatggagctgagcagcctgaga
tctgaggacacggccgtgtattactgtgcgcgctactggtcttactcttcgactacctgtacatgccggaaggtaacgattggtgggt
caaggtactctggtgaccgtctcctca [SEQ ID NO: 98]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSGAPGQGVTIPCTGSSSNIGAGYDVHWYQQLPGTAPKLLIYGNNNRPSGVP
DRFSGSRSGSSASLAITGLQAEDEADYYCQSYDSSLSDVVFGGGTKVTVLG [SEQ ID NO:
99]

SRGGGGSGGGGSGGGGSLEMA [SEQ ID NO: 307]

EVQLVQSGAEVKKPGATVKISCKVSGYTFTDYYMHWVQQAPGKGLEWMGLVDPE
DGETIYAEKFQGRVTITADTSTDTAYMELSSLRSEDTAVYYCARYWSYSFDYLYMPE
GNDWWGQGTLVTVSS [SEQ ID NO: 100]

TSGQAGQHHHHHGAYPYDVPDYAS [SEQ ID NO: 308]

TABLE 26

ET200-028
DNA Sequence
(light chain variable region scFv linker heavy chain variable region His tag + HA tag)
cagtctgtgttgactcagccaccctcagcgtctgggaccccggacagagagtcaccatctcttgttctggggggcgtctccaacatcgggagt
ggtgctctaaattggtaccagcaactcccaggaacgccccaaactcctcatctatagttacaatcagcggccctcaggggtctctgaccgat
tctctggctccaggtctgccacctcagcctccctggccatcagtgggctccagtctgaggatgaggctgattattactgtgcaacctgggatgat
agtgtgaatggttgggtgttcggcggagggaccaagctgaccgtcctaggt [SEQ ID NO: 101]

tctagaggtggtggtggtagcggcggcggcggctctggtggtggtggatccctcgagatggcc [SEQ ID NO: 305]

caggtccagctggtacagtctggagctgaggtgaagaagcctggggattcagtgaaggtctcctgcaagccttctggttacaattttct
caactatggtatcaactgggtgcgacaggcccctggacaagggcttgagtggatgggatggattagcacttacaccggtaacacaaa
ctatgcacagaagctgcagggcagagtcaccttcaccacagacacatccacgagcacagcctacatggagatgaggagcctgagat
ctgacgacacggccgtgtattactgtgcgcgcgacctgtactactacgaaggtgttgattactggggtcaaggtactctggtgaccgtc
tcctca [SEQ ID NO: 102]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPAASGTPGQRVTISCSGGVSNIGSGALNWYQQLPGTAPKLLIYSYNQRPSGVSD
RFSGSRSATSASLAISGLQSEDEADYYCATWDDSVNGWVFGGGTKLTVLG [SEQ ID NO:
103]

SRGGGGSGGGGSGGGGSLEMA [SEQ ID NO: 307]

QVQLVQSGAEVKKPGDSVKVSCKPSGYNFLNYGINWVRQAPGQGLEWMGWISTYTGNT
NYAQKLQGRVTFTTDTSTSTAYMEMRSLRSDDTAVYYCARDLYYYEGVDYWGQGTLVT
VSS [SEQ ID NO: 104]

TSGQAGQHHHHHGAYPYDVPDYAS [SEQ ID NO: 308]

TABLE 27

ET200-029
DNA Sequence
(light chain variable region scFv linker heavy chain variable region His tag + HA tag)
caggctgtgctgactcagccaccctcagtgtcagtggccccaggaaagacggccagggttacctgtgggggaaacaacattggaagtgaaa
gtgtgcactggtaccagcagaagccaggccccaggccctgtgttggtcatctattatgataccgaccggccctcagggatccctgagcgattct
ctggctccactctgggaccacggccaccctgaccatcagcagggtcgaagccggggatgaggccgactattactgtcaggtgtgggatag
tagtagggatcatgtggtattcggcggagggaccaagctgaccgtcctaggt [SEQ ID NO: 105]

<u>tctagaggtggtggtggtagcggcggcggcggctctggtggtggtggatccctcgagatggcc</u> [SEQ ID NO: 305]

**caggtgcagctggtgcagtctgggggaggcgtggtccagcctggggaggtccctgagactctcctgtgcggcctctggattcaccttca
gtagctatgctatgcactgggtccgccaggctccaggcaaggggctggagtgggtggcagttatatcatatgatggaagcaataat
actacgcagactccgtgaagggcctattcaccatctccagagacaattccaagaacacgctgtatctgcaaatgaacagcctgagag
ctgaggacacggccgtgtattactgtgcgcgctcttacttcacttctggtttctacgattactggggtcaaggtactctggtgaccgtctc
ctca** [SEQ ID NO: 106]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSVSVAPGKTARVTCGGNNIGSESVHWYQQKPGQAPVLVIYYDTDRPSGIPER
FSGSHSGTTATLTISRVEAGDEADYYCQVWDSSRDHVVFGGGTKLTVLG [SEQ ID NO:
107]

<u>SRGGGGSGGGGSGGGGSLEMA</u> [SEQ ID NO: 307]

**QVQLVQSGGGVVQPGRSLRLSCAASGFTFSSYAMHWVRQAPGKGLEWVAVISYDGS
NKYYADSVKGLFTISRDNSKNTLYLQMNSLRAEDTAVYYCARSYFTSGFYDYWGQG
TLVTVSS** [SEQ ID NO: 108]

TSGQAGQHHHHHHGAYPYDVPDYAS [SEQ ID NO: 308]

TABLE 28

ET200-030
DNA Sequence
(light chain variable region scFv linker heavy chain variable region His tag + HA tag)
cagtctgtcgtgacgcagccgccctcagtgtctggggccccagggcagagggtcaccatctcctgcactgggagcagttccaacatcgggg
caggtttatgatgtaaattggtatcagcagtttccaggaacagcccccaaactcctcatctatggtaacagcaatcggccctcaggggtccctga
ccgattctctggctccaagtctggcacctcagcctccctggccatcactgggctccaggctgaggatgaggctgattattactgccagtcctatg
acagcagcctgagtggctcttatgtcttcggaactgggaccaaggtcaccgtcctaggt [SEQ ID NO: 109]

<u>tctagaggtggtggtggtagcggcggcggcggctctggtggtggtggatccctcgagatggcc</u> [SEQ ID NO: 305]

**cagatgcagctggtgcagtctggggctgaggtgaagaagcctggggcctcagtgaaggtctcctgcaaggcttccggatacacccctc
actgaattatccatgcactgggtgcgacaggctcctggaaaaggggcttgagtggatgggaggttttgatcctgaagatggtgaaaca
atctacgcacagaagttccagggcagagtcaccatgaccgaggacacatctacagacacagcctacatggagctgagcagcctgag
atctgaggacactgccgtgtattactgtgcgcgcatgtcttctatgtactacgattggggtcaaggtactctggtgaccgtctcctca**
[SEQ ID NO: 110]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSGAPGQRVTISCTGSSSNIGAGYDVNWYQQFPGTAPKLLIYGNSNRPSGVP
DRFSGSKSGTSASLAITGLQAEDEADYYCQSYDSSLSGSYVFGTGTKVTVLG [SEQ ID NO:
111]

<u>SRGGGGSGGGGSGGGGSLEMA</u> [SEQ ID NO: 307]

**QMQLVQSGAEVKKPGASVKVSCKASGYTLTELSMHWVRQAPGKGLEWMGGFDPE
DGETIYAQKFQGRVTMTEDTSTDTAYMELSSLRSEDTAVYYCARMSSMYYDWGQG
TLVTVSS** [SEQ ID NO: 112]

TSGQAGQHHHHHHGAYPYDVPDYAS [SEQ ID NO: 308]

TABLE 29

ET200-031
DNA Sequence
(light chain variable region scFv linker heavy chain variable region His tag + HA tag)
tcctatgtgctgactcagccaccctcagtgtcagtggccccaggaaagacggccaggattacctgtgggggaaacaacattggaagtaaaag
tgtgcactggtaccagcagaagccaggccaggcccctgtgctgatctattatgatagcgaccggccctcagggatccctgagcgattctc
tggctccaactctgggaacacggccacccctgaccatcagcagggtcgaagccggggatgaggccgactattactgtcaggtgtgggatagt
agtagtgattatgtcttcggaactgggaccaaggtcaccgtcctaggt [SEQ ID NO: 113]

tctagaggtggtggtggtagcggcggcggcggctctggtggtggtggatccctcgagatggcc [SEQ ID NO: 305]

gaggtgcagctggtggagactggggggaggcttggtcaagcctggagggtccctgagactctcctgtgcagcctctggattcaccgtca
gtgactactacatgagctggatccgccaggctccagggaagggcctggagtggatttcatacattagtggtagtggtaatagcatata
ctacgcagactctgtgaagggccgattcaccatctccagggacaacgccaagaactcactggatctgcaaatgaccagcctgagagc
cgaggacacggccgtatattactgtgcgcgctctactaaattcgattactggggtcaaggtactctggtgaccgtctcctca [SEQ
ID NO: 114]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVIYYDSDRPSGIPERF
SGSNSGNTATLTISRVEAGDEADYYCQVWDSSSDYVFGTGTKVTVLG [SEQ ID NO: 115]

SRGGGGSGGGGSGGGGSLEMA [SEQ ID NO: 307]

EVQLVETGGGLVKPGGSLRLSCAASGFTVSDYYMSWIRQAPGKGLEWISYISGSGNS
IYYADSVKGRFTISRDNAKNSLDLQMTSLRAEDTAVYYCARSTKFDYWGQGTLVTVS
S [SEQ ID NO: 116]

TSGQAGQHHHHHHGAYPYDVPDYAS [SEQ ID NO: 308]

TABLE 30

ET200-032
DNA Sequence
(light chain variable region scFv linker heavy chain variable region His tag + HA tag)
ctgcctgtgctgactcagccaccctcagcgtctgggaccccgggcagagggtcaccatctcttgttctggaagcagctccaacgtcggaagt
tacactgtaaactggtaccggcaactcccaggaacggccccacactcctcatctataataataatcagcggccctcaggggtccctgaccga
ttctctgactccaagtctggcacctcggcctccctgaccattagtgggctccagcctgaggatgaggctgattattattgtgcagcatgggatga
caggctgggtggttatgtcttcggaactgggaccaaggtcaccgtcctaggt [SEQ ID NO: 117]

tctagaggtggtggtggtagcggcggcggcggctctggtggtggtggatccctcgagatggcc [SEQ ID NO: 305]

gaggtgcagctggtgcagtctggagcagaggtgaaaaagccgggggagtctctgaagatctcctgtaagggttctggatacagcttt
accaactactggatcggctgggtgcgccagatgcccgggaaaggcctggagtggatggggatcatctatcctggtgactctgatacc
agatacagcccgtccttccaaggccaggtcaccatctcagccgacaagtccatcagcaccgcctacctacagtggagcagcctgaag
gcctcggacaccgccatgtattactgtgcgcgctctactggttcttctcatatgtctgatgaatggggtcaaggtactctggtgaccgtct
cctca [SEQ ID NO: 118]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
LPVLTQPPSASGTPGQRVTISCSGSSSNVGSYTVNWYRQLPGTAPTLLIYNNNQRPSGVPD
RFSDSKSGTSASLTISGLQPEDEADYYCAAWDDRLGGYVFGTGTKVTVLG [SEQ ID NO:
119]

SRGGGGSGGGGSGGGGSLEMA [SEQ ID NO: 307]

EVQLVQSGAEVKKPGESLKISCKGSGYSFTNYWIGWVRQMPGKGLEWMGHYPGDS
DTRYSPSFQGQVTISADKSISTAYLQWSSLKASDTAMYYCARSTGSSHMSDEWGQGT
LVTVSS [SEQ ID NO: 120]

TSGQAGQHHHHHHGAYPYDVPDYAS [SEQ ID NO: 308]

TABLE 31

ET200-033
DNA Sequence
(light chain variable region scFv linker heavy chain variable region His tag + HA tag)
aattttatgctgactcagccccactctgtgtcggagtctccggggaagacggtaaccatctcctgcaccggcagcagtggcagcattgccagc
aactatgtgcagtggtaccagcagcgcccgggcagtgccccaccactgtgatctatgaggataaccaaagaccctctgggtccctgatcg
gttctctggctccatcgacagctcctccaactctgcctccctcaccatctctggactgaagactgaggacgaggctgactactactgtcagtctta
tgatagcagcaatcattgggtgttcggcggagggaccaagctgaccgtcctaggt [SEQ ID NO: 121]

tctagaggtggtggtggtagcggcggcggcggctctggtggtggtggatccctcgagatggcc [SEQ ID NO: 305]

**caagtgcagctacagcagtggggcgcaggactgttgaagccttcggagaccctgtccctcacctgcgctgtctatggtgggtccttca
gtggttactactggagctggatccgccagccccaggaaggggctggagtggattgggagatcactcatagtggaaggtccaact
acaacccgtccctcaagagtcgagtcaccatatcagtagacacgtccaagaaccagttctccctgaagctgagctctgtgaccgccgc
ggacacggccgtgtattactgtgcgcgctcttctatcatgtctgattactggggtcaaggtactctggtgaccgtctcctca** [SEQ ID
NO: 122]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSGSIASNYVQWYQQRPGSAPTTVIYEDNQRPSGVPD
RFSGSIDSSSNSASLTISGLKTEDEADYYCQSYDSSNHWVFGGGTKLTVLG [SEQ ID NO:
123]

SRGGGGSGGGGSGGGGSLEMA [SEQ ID NO: 307]

**QVQLQQWGAGLLKPSETLSLTCAVYGGSFSGYYWSWIRQPPGKGLEWIGEITHSGR
SNYNPSLKSRVTISVDTSKNQFSLKLSSVTAADTAVYYCARSSIMSDYWGQGTLVTVS
S** [SEQ ID NO: 124]

TSGQAGQHHHHHHGAYPYDVPDYAS [SEQ ID NO: 308]

TABLE 32

ET200-034
DNA Sequence
(light chain variable region scFv linker heavy chain variable region His tag + HA tag)
cagtctgtgttgacgcagccgccctcagtgtctggggccccagggcagagggtcaccatctcctgcactgggagcacctccaacatcgggg
caggtttatgatgtacactggtaccagcagcttccaggaacagcccccaaactcctcatcaacaataacaggaatcggccctcaggggtccctg
accgattctctggctccaagtctggcacgtcagccaccctgggcatcaccggactccagactggggacgaggccgattattactgcggaaca
tgggatggcagcctgactggtgcagtgttcggcggagggaccaagctgaccgtcctaggt [SEQ ID NO: 125]

tctagaggtggtggtggtagcggcggcggcggctctggtggtggtggatccctcgagatggcc [SEQ ID NO: 305]

**gaggtccagctggtgcagtctggggctgaggtgaagaagcctggggtcctcggtgaaggtctcatgcaaggcttctggaggcaccttc
agcagctatgctatcagctgggtgcgacaggcccctggacaagggcttgagtggatgggagggatcatccctatctttggtacagca
aactacgcacagaagttccagggcagagtcacgattaccgcggacgaatccacgagcacagcctacatggagctgagcagcctga
gatctgaggacacggccgtgtattactgtgcgcgcggttctgctctggaccattacgatcgttggggtcaaggtactctggtgaccgtct
cctca** [SEQ ID NO: 126]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSTSNIGAGYDVHWYQQLPGTAPKLLINNNRNRPSGVP
DRFSGSKSGTSATLGITGLQTGDEADYYCGTWDGSLTGAVFGGGTKLTVLG [SEQ ID NO:
127]

SRGGGGSGGGGSGGGGSLEMA [SEQ ID NO: 307]

**EVQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARGSALDHYDRWGQGTL
VTVSS** [SEQ ID NO: 128]

TSGQAGQHHHHHHGAYPYDVPDYAS [SEQ ID NO: 308]

TABLE 33

ET200-035
DNA Sequence
(light chain variable region scFv linker heavy chain variable region His tag + HA tag)
aattttatgctgactcagcccactctgtgtcggagtctccggggaagacggtaaccatctcctgcacccgcagcagtggcagcattgccagc
aactatgtgcagtggtaccagcagccgcccgggcagtgcccccaccactgtgatctatgaggataaccaaagaccctctgggtccctgatcg
gttctctggctccatcgacagctcctccaactctgcctcctccaccatctctggactgaagactgaggacgaggctgactactactgtcagctta
tgatagcaccaattgggtgttcggcggagggaccaagctgaccgtcctaggt [SEQ ID NO: 129]

tctagaggtggtggtggtagcggcggcggcggctctggtggtggtggatccctcgagatggcc [SEQ ID NO: 305]

caggtgcagctggtgcagtctggggctgaggtgaagaagcctgggtcctcggtgaaggtctcctgcaaggcttctggaggcaccttca
gcagctatgctatcagctgggtgcgacaggcccctggacaagggcttgagtggatgggagggatcatccctatctttggtacagcaa
actacgcacagaagttccagggcagagtcacgattaccgcggacgaatccacgagcacagcctacatggagctgagcagctgag
atctgaggacactgccgtgtattactgtgcgcgctacaactactacttcaacgattactggggtcaaggtactctggtgaccgtctcctc
a [SEQ ID NO: 130]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSAPTTVIYEDNQRPSGVPD
RFSGSIDSSSNSASLTISGLKTEDEADYYCQSYDSTNWVFGGGTKLTVLG [SEQ ID NO: 131]

SRGGGGSGGGGSGGGGSLEMA [SEQ ID NO: 307]

**QVQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARYNYYFNDYWGQGTLV
TVSS** [SEQ ID NO: 132]

TSGQAGQHHHHHHGAYPYDVPDYAS [SEQ ID NO: 308]

TABLE 34

ET200-037
DNA Sequence
(light chain variable region scFv linker heavy chain variable region His tag + HA tag)
tcctatgtgctgactcagccacccctcagtgtcagtggccccaggaaagacggccaggattacctgtgggggaaacaacattggaagtaaaag
tgtgcactggtaccagcagaagccaggccaggcccctgtgctggtcatctattatgatagcgaccggccctcagggatccctgagcgattctc
tggctccaactctgggaacacggccaccctgaccatcagcagggtcgaagccggggatgaggccgactattactgtcaggtgtgggatagt
agtagtgatcatccttatgtcttcggaactgggaccaaggtcaccgtcctaggt [SEQ ID NO: 133]

tctagaggtggtggtggtagcggcggcggcggctctggtggtggtggatccctcgagatggcc [SEQ ID NO: 305]

cagatgcagctggtgcagtctggagctgaggtgaagaagcctggggcctcagtgaaggtctcctgcaaggcttctggttacacctttta
ccagctatggtatcagctgggtgcgacaggcccctggacaagggcttgagtggatgggatggatcagcgcttacaatggtaacacaa
actatgcacagaagctccagggcagagtcaccatgaccacagacacatccacgagcacagcctacatggagctgaggagcctgag
atctgacgacactgccgtgtattactgtgcgcgctctatgttcggtgctcatgattcttggggtcaaggtactctggtgaccgtctcctca
[SEQ ID NO: 134]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVIYYDSDRPSGIPERF
SGSNSGNTATLTISRVEAGDEADYYCQVWDSSSDHPYVFGTGTKVTVLG [SEQ ID NO: 135]

SRGGGGSGGGGSGGGGSLEMA [SEQ ID NO: 307]

**QMQLVQSGAEVKKPGASVKVSCKASGYTFTSYGISWVRQAPGQGLEWMGWISAYN
GNTNYAQKLQGRVTMTTDTSTSTAYMELRSLRSDDTAVYYCARSMFGAHDSWGQG
TLVTVSS** [SEQ ID NO: 136]

TSGQAGQHHHHHHGAYPYDVPDYAS [SEQ ID NO: 308]

TABLE 35

ET200-038
DNA Sequence
(light chain variable region scFv linker heavy chain variable region His tag + HA tag)
cagtctgtgttgacgcagccgccctcagtgtctgggggccccagggcagagggtcaccatctcctgcactgggagcagctccaacatcggg
gcaggttttgatgtacactggtaccagctacttccaggaacagccccaaactcctcatctatgctaacagcaatcggccctcaggggtccct
gaccgattctctggctccaagtctggcacctcagcctccctggccatcactgggctcctggctgaggatgaggctgattattactgccagtcct
atgacagcagcctgagtggtgtggtattcggcggagggaccaagctgaccgtcctaggt [SEQ ID NO: 137]

<u>tctagaggtggtggtggtagcggcggcggcggctctggtggtggtggatccctcgagatggcc</u> [SEQ ID NO: 305]

**caggtgcagctggtgcaatctgggggctgaggtgaagaagcctggggtcctcggtgaaggtctcctgcaaggcttctggaggcaccttc
agcagctatgctatcagctgggtgcgacaggcccctggacaagggcttgagtggatgggagggatcatccctatctttggtacagca
aactacgcacagaagttccagggcagagtcacgattaccgcggacgaatccacgagcacagcctacatggagctgagcagcctga
gatctgaggacactgccgtgtattactgtgcgcgcggtgcttcttcgaccgtcatgataactgggggtcaaggtactctggtgaccgtc
tcctca** [SEQ ID NO: 138]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSSSNIGAGFDVHWYQLLPGTAPKLLIYANSNRPSGVP
DRFSGSKSGTSASLAITGLLAEDEADYYCQSYDSSLSGVVFGGGTKLTVLG [SEQ ID NO:
139]

<u>SRGGGGSGGGGSGGGGSLEMA</u> [SEQ ID NO: 307]

**QVQLVQSGAEVKKPGSSVKVSCKASGGTFSSYAISWVRQAPGQGLEWMGGIIPIFG
TANYAQKFQGRVTITADESTSTAYMELSSLRSEDTAVYYCARGASFDRHDNWGQGT
LVTVSS** [SEQ ID NO: 140]

TSGQAGQHHHHHGAYPYDVPDYAS [SEQ ID NO: 308]

TABLE 36

ET200-039
DNA Sequence
(light chain variable region scFv linker heavy chain variable region His tag + HA tag)
aattttatgctgactcagccccactctgtgtcggagtctccggggaagacggtaaccatctcctgcacccgcagcagtggcagcattgccagc
aactatgtgcagtggtaccagcagcgcccgggcagttcccccaccactgtgatctatgaggataaccaaagaccctctggggtccctgatcg
gttctctggctccatcgacagctcctccaactctgcctcctcaccatctctggactgaagactgaggacgaggctgactactactgtcagtc
ttatgatagcagcaattgggtgttcggcggagggaccaagctgaccgtcctaggt [SEQ ID NO: 141]

<u>tctagaggtggtggtggtagcggcggcggcggctctggtggtggtggatccctcgagatggcc</u> [SEQ ID NO: 305]

**gaggtccagctggtgcagtctgggggctgaggtgaagaagcctggggtcctcggtgaaggtctcctgcaaggcttctggaggcaccttca
gcagctatgctatcagctgggtgcgacaggcccctggacaagggcttgagtggatgggagggatcatccctatctttggtacagcaa
actacgcacagaagttccagggcagagtcacgattaccgcggacgaatccacgagcacagcctacatggagctgagcagcctgag
atctgaggacacggccgtgtattactgtgcgcgctctaactactactacaacgattactgggggtcaaggtactctggtgaccgtctcctc
a** [SEQ ID NO: 142]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSSPTTVIYEDNQRPSGVPD
RFSGSIDSSSNSASLTISGLKTEDEADYYCQSYDSSNWVFGGGTKLTVLG [SEQ ID NO:
143]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARSNYYYNDYWGQGTLV
TVSS** [SEQ ID NO: 144]

TSGQAGQHHHHHGAYPYDVPDYAS [SEQ ID NO: 308]

TABLE 37

ET200-040
DNA Sequence
(light chain variable region scFv linker heavy chain variable region His tag + HA tag)
cagtctgtgttgacgcagccgccctcagtgtctggggcccccagggcagagggtcaccatctcctgcactgggagcagctccaacatcggggg
caggtttatgatgtacactggtaccagcagcttccaggaacagcccccaaactcctcatctatggtaacagcaatcggccctcaggggtccctg
accgattctctggctccaagtctggcacctcagcctccctggccatcactgggctccaggctgaggatgaggctgattattactgccagtcct
atgacagcagcctgagtggttatgtcttcggaactgggaccaaggtcaccgtcctaggt [SEQ ID NO: 145]

tctagaggtggtggtggtagcggcggcggcggctctggtggtggtggatccctcgagatggcc [SEQ ID NO: 305]

**caggtgcagctggtgcagtctggggctgaggtgaagaagcctggggcctcagtgaaggtctcctgcaaggtttccggatacaccctc
actgaattatccatgcactgggtgcgacaggctcctggaaaagggcttgagtggatgggaggttttgatcctgaagatggtgaaaca
atctacgcacagaagttccagggcagagtcaccatgaccgaggacacatctacagacacagcctacatggagctgagcagctgag
atctgaggacactgccgtgtattactgtgcgcgctactctggtgtttactacgattggggtcaaggtactctggtgaccgtctcctca**
[SEQ ID NO: 146]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSSNIGAGYDVHWYQQLPGTAPKLLIYGNSNRPSGVP
DRFSGSKSGTSASLAITGLQAEDEADYYCQSYDSSLSGYVFGTGTKVTVLG [SEQ ID NO:
147]

SRGGGGSGGGGSGGGGSLEMA [SEQ ID NO: 307]

**QVQLVQSGAEVKKPGASVKVSCKVSGYTLTELSMHWVRQAPGKGLEWMGGFDPE
DGETIYAQKFQGRVTMTEDTSTDTAYMELSSLRSEDTAVYYCARYSGVYYDWGQGT
LVTVSS** [SEQ ID NO: 148]

TSGQAGQHHHHHGAYPYDVPDYAS [SEQ ID NO: 308]

TABLE 38

ET200-041
DNA Sequence
(light chain variable region scFv linker heavy chain variable region His tag + HA tag)
aattttatgctgactcagccccactctgtgtcggggtctccggggaagacggtaaccatctcctgcaccggcagcagtggcagcattgccgac
aactttgtgcagtggtaccagcagcgcccgggcggtgtcccaccactgtgatctttaatgatgacgaaagaccctctggcgtcctgatcggt
tctctggctccatcgacacctcctccaattctgcctccctcaccatctctggactgaagactgaggacgaggctgactactactgtcagtc
ttatgataataataatcgagggggtgttcggcggagggaccaagctgaccgtcctaggt [SEQ ID NO: 149]

tctagaggtggtggtggtagcggcggcggcggctctggtggtggtggatccctcgagatggcc [SEQ ID NO: 305]

**caggtccagctggtgcagtctggggctgaggtgaagaagcctgggtcctcggtgaaggtctcctgcaaggcttctggaggcaccttca
gcagctatgctatcagctgggtgcgacaggcccctggacaagggcttgagtggatgggatggatgaaccctaacagtggtaacaca
ggctatgcacagaagttccagggcagagtcaccatgaccaggaacacctccataagcacagcctacatggagctgagcaacctgag
atctgaggacacggccgtgtattactgtgcgcgctactactcttacggttacgattggggtcaaggtactctggtgaccgtctcctca**
[SEQ ID NO: 150]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSGSPGKTVTISCTGSSGSIADNFVQWYQQRPGGVPTTVIFNDDERPSGVPD
RFSGSIDTSSNSASLTISGLKTEDEADYYCQSYDNNNRGVFGGGTKLTVLG [SEQ ID NO:
151]

SRGGGGSGGGGSGGGGSLEMA [SEQ ID NO: 307]

**QVQLVQSGAEVKKPGSSVKVSCKASGGTFSSYAISWVRQAPGQGLEWMGWMNPNS
GNTGYAQKFQGRVTMTRNTSISTAYMELSNLRSEDTAVYYCARYYSYGYDWGQGT
LVTVSS** [SEQ ID NO: 152]

TSGQAGQHHHHHGAYPYDVPDYAS [SEQ ID NO: 308]

TABLE 39

ET200-042
DNA Sequence
(light chain variable region scFv linker heavy chain variable region His tag + HA tag)
cagtctgtcgtgacgcagccgcccctcagtgtctgggccccagggcagacggtcaccatctcctgcactggggggcagctccaacatcggga
caggttattttgtaaattggtaccagcaggttccaggaaaagcccccaaactcctcatcctgggtaacaataatcggccctcgggggtccctga
ccgactctccggctccacgtccggcacctcagccctcctggccatcactgggctccaggctgaggatgagggtacttattactgccagtcctat
gacagcagcctgagtggttatgtcttcggaactgggaccaaggtcaccgtcctaggt [SEQ ID NO: 153]

<u>tctagaggtggtggtggtagcggcggcggcggctctggtggtggtggatccctcgagatggcc</u> [SEQ ID NO: 305]

**caggtacagctgcagcagtcaggtccaggactggtgaagccctcgcagaccctctcactcacctgtggcatctccggggacagtgtct
ctaccaacagtgttgcttggcactggatcaggcagtccccatcgagaggccttgagtggctgggaaggacatactacaggtccaagt
ggtctaatgactatggagtatctgtgaaaagtcgaatcaccatcatcccagacacatccaagaaccagttctccctgcagctgaactct
gtgactcccgaggacacggctgtgtattactgtgcgcgctcttcttcttggtaccagatcttcgattactggggtcaaggtactctggtga
ccgtctcctca** [SEQ ID NO: 154]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSGAPGQTVTISCTGGSSNIGTGYFVNWYQQVPGKAPKLLILGNNNRPSGVP
DRLSGSTSGTSASLAITGLQAEDEGTYYCQSYDSSLSGYVFGTGTKVTVLG [SEQ ID NO: 155]

<u>SRGGGGSGGGGSGGGGSLEMA</u> [SEQ ID NO: 307]

**QVQLQQSGPGLVKPSQTLSLTCGISGDSVSTNSVAWHWIRQSPSRGLEWLGRTYYRS
KWSNDYGVSVKSRITIIPDTSKNQFSLQLNSVTPEDTAVYYCARSSSWYQIFDYWGQG
TLVTVSS** [SEQ ID NO: 156]

TSGQAGQHHHHHHGAYPYDVPDYAS [SEQ ID NO: 308]

TABLE 40

ET200-043
DNA Sequence
(light chain variable region scFv linker heavy chain variable region His tag + HA tag)
aattttatgctgactcagccccactctgtgtcggagtctccggggaagacggtaaccatctcctgcaccggcagcagcgacagcatagccaac
aactatgttcagtggtaccagcagcgcccgggcagtgcccccaccaatgtgatctacgaagatgtccaaagaccctctgggtccctgatcg
gttctctgggtccatcgacagctcctccaactctgcctccctcaccatctctggactgaagactgaggacgaggctgtctactattgtcagtc
ttatcatagcgacaatcgttgggtgttcggcggcgggaccaagctgaccgtcctaggt [SEQ ID NO: 157]

<u>tctagaggtggtggtggtagcggcggcggcggctctggtggtggtggatccctcgagatggcc</u> [SEQ ID NO: 305]

**caggtgcagctggtggagtctggggaggcttggtacagcctggggggtccctgagactctcctgtgcagcctctggattcaccttag
cagctatgccatgagctgggtccgccaggctccagggaaggggctggagtgggtctcagctattagtggtagtggtggtagcacata
ctacgcagactccgtgaagggccggttcaccatctccagagacaattccaagaacacgctgtatctgcaaatgaacagcctgagagc
cgaggacacggccgtatattactgtgcgcgctctggtgcttactgggactactctgtttacgatgaatggggtcaaggtactctggtga
ccgtctcctca** [SEQ ID NO: 158]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSDSIANNYVQWYQQRPGSAPTNVIYEDVQRPSGVPD
RFSGSIDSSSNSASLTISGLKTEDEAVYYCQSYHSDNRWVFGGGTKLTVLG [SEQ ID NO: 159]

<u>SRGGGGSGGGGSGGGGSLEMA</u> [SEQ ID NO: 307]

**QVQLVESGGGLVQPGGSLRLSCAASGFTFSSYAMSWVRQAPGKGLEWVSAISGSGG
STYYADSVKGRFTISRDNSKNTLYLQMNSLRAEDTAVYYCARSGAYWDYSVYDEWG
QGTLVTVSS** [SEQ ID NO: 160]

TSGQAGQHHHHHHGAYPYDVPDYAS [SEQ ID NO: 308]

TABLE 41

ET200-044
DNA Sequence
(light chain variable region scFv linker heavy chain variable region His tag + HA tag)
cagtctgtgttgactcagccaccctcagtgtccgtgtccccaggacagacagccaccatcgcctgttctggacataaatttggggataaatatg
cttcctggtatcagcagaagtcgggccagtccccctgtgttgatcatctatcaggataataagcggccctcagggattcctgagcgattctctgg
ctccaactctgggaacacagccactctgaccatcagcggacccaggctctggatgaggctgactattattgtcaggcgtgggacagtagtact
tatgtggcattcggcggagggaccaagctgaccgtcctaggt [SEQ ID NO: 161]

<u>tctagaggtggtggtggtagcggcggcggcggctctggtggtggtggatccctcgagatggcc</u> [SEQ ID NO: 305]

**caggtgcagctgcaggagtccggcccaggactggtgaagccttcggagaccctgtccctcacctgcgttgtctctggtggctccatca
gcagtagtaactggtggagctgggtccgccagccccaggggaaggggctggagtggattggggaaatctatcatagtgggagcccc
aactacaaccccatccctcaagagtcgagtcaccatatcagtagacaagtccaagaaccagttctccctgaagctgagctctgtgaccg
ccgcggacacggccgtgtattactgtgcgcgcatgactactcatactttcggttacgatgcttggggtcaaggtactctggtgaccgtct
cctca** [SEQ ID NO: 162]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSVSPGQTATIACSGHKLGDKYASWYQQKSGQSPVLIIYQDNKRPSGIPERFS
GSNSGNTATLTISGTQALDEADYYCQAWDSSTYVAFGGGTKLTVLG [SEQ ID NO: 163]

<u>SRGGGGSGGGGSGGGGSLEMA</u> [SEQ ID NO: 307]

**QVQLQESGPGLVKPSETLSLTCVVSGGSISSSNWWSWVRQPPGKGLEWIGEIYHSGS
PNYNPSLKSRVTISVDKSKNQFSLKLSSVTAADTAVYYCARMTTHTFGYDAWGQGTL
VTVSS** [SEQ ID NO: 164]

TSGQAGQHHHHHHGAYPYDVPDYAS [SEQ ID NO: 308]

TABLE 42

ET200-045
DNA Sequence
(light chain variable region scFv linker heavy chain variable region His tag + HA tag)
cagcctgtgctgactcagccaccctcagtgtcagtggcccaggaaagacggccacgattacttgtgggggaaacaacattggaagtgaaa
gtgtgcactggtaccaccagaagccaggccaggcccctgtgttggtcatctatgatgatgccggccggccctcagggatccctgagcgattc
actggctccaactctgggaacacggccaccctgaccatcagcagggtcgaagccggggatgaggccgactattactgtcaggtgtgggaca
gaaatagtgctcagtttgtcttcggacctgggaccaaggtcaccgtcctaggt [SEQ ID NO: 165]

<u>tctagaggtggtggtggtagcggcggcggcggctctggtggtggtggatccctcgagatggcc</u> [SEQ ID NO: 305]

**gaggtccagctggtgcagtctggagctgaggtgaagaagcctggggcctcagtgaaggtctcctgcaaggcttctggttacacctttta
ccagctatggtatcagctgggtgcgacaggcccctggacaagggcttgagtggatgggatggatcagcgcttacaatggtaacaca
actatgcacagaagctccagggcagagtcaccatgaccacagacacatccacgagcacagcctacatggagctgaggagcctgag
atctgacgacacggccgtgtattactgtgcgcgcggtgttcatctggattggtggggtcaaggtactctggtgaccgtctcctca**
[SEQ ID NO: 166]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QPVLTQPPSVSVAPGKTATITCGGNNIGSESVHWYHQKPGQAPVLVIYDDAGRPSGIPERF
TGSNSGNTATLTISRVEAGDEADYYCQVWDRNSAQFVFGPGTKVTVLG [SEQ ID NO:
167]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGWISAYN
GNTNYAQKLQGRVTMTTDTSTSTAYMELRSLRSDDTAVYYCARGVHLDWWGQGT
LVTVSS** [SEQ ID NO: 168]

TSGQAGQHHHHHHGAYPYDVPDYAS [SEQ ID NO: 308]

TABLE 43

ET200-069
DNA Sequence
(light chain variable region scFv linker heavy chain variable region His tag + HA tag)
cagtctgtcgtgacgcagccaccctcagcgtctgggaccccgggcagagggtcaccatctcttgttctggaagcagctccaacatcggaa
gtaattatgtatactggtaccagcagctcccaggaacggcccccaaactcctcatctatagtaataatcagcggccctcaggggtccctgacc
gattctctggctccaagtctggcacctcagcctccctggccatcagtgggctccggtccgaggatgaggctgattattactgtgcagcatggg
atgacagcctgagtggttatgtcttcggaactgggaccaagctgaccgtcctaggt [SEQ ID NO: 169]

tctagaggtggtggtggtagcggcggcggcggctctggtggtggtggatccctcgagatggcc [SEQ ID NO: 305]

**caggtgcagctacagcagtggggcgcaggactgttgaagccttcggagaccctgtccctcacctgcgctgtctatggtgggtccttca
gtggttactactggagctggatccgccagcccccagggaaggggctggagtggattgggaaatcaatcatagtggaagcaccaa
ctacaacccgtccctcaagagtcgagtcaccatatcagtagacacgtccaagaaccagttctccctgaagctgagctctgtgaccgc
cgcggacacggccgtgtattactgtgcgcgcctatacgaaggtggttaccatggttgggttcttggctgtcttctgattcttggggtca
aggtactctggtgaccgtctcctca** [SEQ ID NO: 170]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSASGTPGQRVTISCSGSSSNIGSNYVYWYQQLPGTAPKLLIYSNNQRPSGVPD
RFSGSKSGTSASLAISGLRSEDEADYYCAAWDDSLSGYVFGTGTKLTVLG [SEQ ID NO:
171]

SRGGGGSGGGGSGGGGSLEMA [SEQ ID NO: 307]

**QVQLQQWGAGLLKPSETLSLTCAVYGGSFSGYYWSWIRQPPGKGLEWIGEINHSGS
TNYNPSLKSRVTISVDTSKNQFSLKLSSVTAADTAVYYCARLYEGGYHGWGSWLSS
DSWGQGTLVTVSS** [SEQ ID NO: 172]

TSGQAGQHHHHHGAYPYDVPDYAS [SEQ ID NO: 308]

TABLE 44

ET200-078
DNA Sequence
(light chain variable region scFv linker heavy chain variable region His tag + HA tag)
cagtctgtgttgactcagccaccctcagcgtctgggaccccgggcagagggtcaccatctcttgttctggaagcagctccaacatcggaagt
aatactgtaaactggtaccagcagctcccaggaacggcccccaaactcctcatctatagtaataatcagcggccctcaggggtccctgaccga
ttctctggctccaagtctggcacctcagcctccctggccatcagtgggctccagtctgaggatgaggctgattattactgtgcagcatgggat
gacagcctgaatggttattgggtgttcggcggagggaccaagctgaccgtcctaggt [SEQ ID NO: 173]

tctagaggtggtggtggtagcggcggcggcggctctggtggtggtggatccctcgagatggcc [SEQ ID NO: 305]

**caggtgcagctacagcagtggggcgcaggactgttgaagccttcggagaccctgtccctcacctgcgctgtctatggtgggtccttca
gtggttactactggagctggatccgccagcccccagggaaggggctggagtggattgggaaatcaatcatagtggaagcaccaac
tacaacccgtccctcaagagtcgagtcaccatatcagtagacacgtccaagaaccagttctccctgaagctgagctctgtgaccgccg
cggacacggctgtgtattactgtgcgcgcgaaggggcatttgatgcttttgatatctggggccaagggacaatggtcaccgtctcttca**
[SEQ ID NO: 174]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYWVFGGGTKLTVLG [SEQ ID NO:
175]

SRGGGGSGGGGSGGGGSLEMA [SEQ ID NO: 307]

QVQLQQWGAGLLKPSETLSLTCAVYGGSFSGYYWSWIRQPPGKGLEWIGEINHSGSTNY
NPSLKSRVTISVDTSKNQFSLKLSSVTAADTAVYYCAREGAFDAFDIWGQGTMVTVS
[SEQ ID NO: 176]

TSGQAGQHHHHHGAYPYDVPDYAS [SEQ ID NO: 308]

TABLE 45

ET200-079
DNA Sequence
(light chain variable region scFv linker heavy chain variable region His tag + HA tag)
tcctatgagctgactcagccaccctcagcgtctgggaccccagggcagagggtcaccatctcttgttctggaagcagctccaacatcggaagt
aattatgtatactggtaccagcagctcccaggaacggccccaaactcttcatctataggaataatcagcggccctcaggggtccctgaccgat
tctctggctccaagtctggcacctcagcctcctggccatcagtgggctccggtccgaggatgaggctgattattactgtgcagcatgggatga
cagcctgagtggttatctcttcggaactgggaccaaggtcaccgtcctaggt [SEQ ID NO: 177]

<u>tctagaggtggtggtggtagcggcggcggcggctctggtggtggtggatccctcgagatggcc</u> SEQ ID NO: 305]

**gaggtgcagctggtggagtctgggggaggcttggtacagcctggcaggtccctgagactctcctgtgcagcctctggattcacctttga
tgattatgccatgcactgggtccggcaagctccagggaagggcctggagtgggtctcaggtattagttggaatagtggtagcataggc
tatgcggactctgtgaagggccgattcaccatctccagagacaacgccaagaactccctgtatctgcaaatgaacagtctgagagctg
aggacacggccttgtattactgtgcaaatggcgactccaactactactacggtatggacgtctggggccaagggaccacggtcaccgt
ctcctca** [SEQ ID NO: 178]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYELTQPPSASGTPGQRVTISCSGSSSNIGSNYVYWYQQLPGTAPKLFIYRNNQRPSGVPDR
FSGSKSGTSASLAISGLRSEDEADYYCAAWDDSLSGYLFGTGTKVTVLG [SEQ ID NO: 179]

<u>SRGGGGSGGGGSGGGGSLEMA</u> [SEQ ID NO: 307]

**EVQLVESGGGLVQPGRSLRLSCAASGFTFDDYAMHWVRQAPGKGLEWVSGISWNS
GSIGYADSVKGRFTISRDNAKNSLYLQMNSLRAEDTALYYCANGDSNYYYGMDVWG
QGTTVTVSS** [SEQ ID NO: 180]

TSGQAGQHHHHHHGAYPYDVPDYAS [SEQ ID NO: 308]

TABLE 46

ET200-081
DNA Sequence
(light chain variable region scFv linker heavy chain variable region His tag + HA tag)
cagtctgccctgactcagcctgcctccgtgtccgggtctcctggacagtcgatcaccatctcctgcactggaaccagcagtgacattggtgtt
ataactatgtcctggtaccaacaacacccaggcaaagcccccaaactcatgatttatgatgtcagtaatcggccctcaggggtttctaatcgc
ttctctggctccaagtctggcaacacggcctcctgaccatctctggctccaggctgaggacgaggctgattattactgcatctcatatacacg
cacctggaacccctatgtcttcggagtgggaccaaggtcaccgtcctaggt [SEQ ID NO: 181]

<u>tctagaggtggtggtggtagcggcggcggcggctctggtggtggtggatccctcgagatggcc</u> [SEQ ID NO: 305]

**gaggtgcagctggtgcagtctgggggaggcgtggtacagcctggggggtccctgagactctcctgtgcagcctctggattcacctttg
atgattatgccatgcactgggtccgtcaagctccagggaagggtctggagtgggtctctcttattagtggggatggtggtagcacatac
tatgcagactctgtgaagggccgattcaccatctccagagacaacagcaaaaactccctgtatctgcaaatgaacagtctgagaact
gaggacaccgccttgtattactgtgcaaaagatcgggcagcagctggctactactactacggtatggacgtctggggccaagggacc
acggtcaccgtctcctca** [SEQ ID NO: 182]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSALTQPASVSGSPGQSITISCTGTSSDIGGYNYVSWYQQHPGKAPKLMIYDVSNRPSGVS
NRFSGSKSGNTASLTISGLQAEDEADYYCISYTRTWNPYVFGSGTKVTVLG [SEQ ID NO: 183]

<u>SRGGGGSGGGGSGGGGSLEMA</u> [SEQ ID NO: 307]

**EVQLVQSGGGVVQPGGSLRLSCAASGFTFDDYAMHWVRQAPGKGLEWVSLISGDG
GSTYYADSVKGRFTISRDNSKNSLYLQMNSLRTEDTALYYCAKDRAAAGYYYYGMD
VWGQGTTVTVSS** [SEQ ID NO: 184]

TSGQAGQHHHHHHGAYPYDVPDYAS [SEQ ID NO: 308]

TABLE 47

ET200-097
DNA Sequence
(light chain variable region scFv linker heavy chain variable region His tag + HA tag)
ctgcctgtgctgactcagccaccctcagtgtccgtgtccccaggacagacagccatcatcacctgctctggagataaattggggaaaaatat
gtttcctggtatcagcagaagccaggccagtcccctgtactggtcatcgatcaagataccaggaggccctcagggatccctgagcgattctctg
gctccaactctgggaccacagccactctgaccatcagcgggacccaggctatggatgaggctgactattactgtcaggcgtgggacagggt
gtggtattcggcggagggaccaagctgaccgtcctaggt [SEQ ID NO: 185]

tctagaggtggtggtggtagcggcggcggcggctctggtggtggtggatccctcgagatggcc [SEQ ID NO: 305]

gaggtgcagctggtggagtctgggggagacttggtacagcctggcaggtccctgagactctcctgtgcagcctctggattcacctttaa
tgattatgccatgcactgggtccggcaagctccagggaagggcctggagtgggtctcaggtattagttgagtggtaataacataggc
tatgcggactctgtgaagggccgattcaccatctccagagacaacgccaagaactccctgtatctgcaaatgaacagtctgagagctg
aggacacggccttgtattactgtgcaaaagatagtatacggtatggcatcacctgggggaggttttgactactggggccagggaaccct
ggtcaccgtctcctca [SEQ ID NO: 186]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
LPVLTQPPSVSVSPGQTAIITCSGDKLGEKYVSWYQQKPGQSPVLVIDQDTRRPSGIPERFS
GSNSGTTATLTISGTQAMDEADYYCQAWDRGVVFGGGTKLTVLG [SEQ ID NO: 187]

SRGGGGSGGGGSGGGGSLEMA [SEQ ID NO: 307]

EVQLVESGGDLVQPGRSLRLSCAASGFTFNDYAMHWVRQAPGKGLEWVSGISWSG
NNIGYADSVKGRFTISRDNAKNSLYLQMNSLRAEDTALYYCAKDSIRYGITWGGFDY
WGQGTLVTVSS [SEQ ID NO: 188]

TSGQAGQHHHHHHGAYPYDVPDYAS [SEQ ID NO: 308]

TABLE 48

ET200-098
DNA Sequence
(light chain variable region scFv linker heavy chain variable region His tag + HA tag)
cagcctgtgctgactcagccaccctcggtgtccaagggcttgagacagaccgccacactcacctgcactgggaacagcaacaatgttggcaa
cctaggagtagcttggctgcagcagcaccagggccaccctcccaaactcctatcctacaggaataacaaccggccctcagggatctcagag
agattatctgcatccaggtcaggaaacacagcctccctgaccattactggactccagcctgaggacgaggctgactattactgctcagcatgg
gacagtagcctcagtgcttgggtgttcggcggagggaccaagctgaccgtcctaggt [SEQ ID NO: 189]

tctagaggtggtggtggtagcggcggcggcggctctggtggtggtggatccctcgagatggcc [SEQ ID NO: 305]

gaggtgcagctggtggagtctgggggagtcgtggtacagcctggggggtccctgagactctcctgtgcagcctctggattcacctttga
tgattatgccatgcactgggtccgtcaagctccggggaagggtctggagtgggtctctcttattaattgggatggtggtagcacctacta
tgcagactctgtgaagggtcgattcaccatctccagagacaacagcaaaaactccctgtatctgcaaatgaacagtctgagagctga
ggacaccgccttgtattactgtgcaaaagggatgggcctgagggcgtttgactactggggccagggaaccctggtcaccgtctcctca
[SEQ ID NO: 190]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QPVLTQPPSVSKGLRQTATLTCTGNSNNVGNLGVAWLQQHQGHPPKLLSYRNNNRPSGIS
ERLSASRSGNTASLTITGLQPEDEADYYCSAWDSSLSAWVFGGGTKLTVLG [SEQ ID NO:
191]

SRGGGGSGGGGSGGGGSLEMA [SEQ ID NO: 307]

EVQLVESGGVVVQPGGSLRLSCAASGFTFDDYAMHWVRQAPGKGLEWVSLINWDG
GSTYYADSVKGRFTISRDNSKNSLYLQMNSLRAEDTALYYCAKGMGLRAFDYWGQ
GTLVTVSS [SEQ ID NO: 192]

TSGQAGQHHHHHHGAYPYDVPDYAS [SEQ ID NO: 308]

TABLE 49

ET200-099
DNA Sequence
(light chain variable region scFv linker heavy chain variable region His tag + HA tag)
cagtctgtgttgactcagccaccctcagcgtctgggaccccccgggcagagggtcaccatctcctgttctggaagcagctccaacatcggaagt
aatactgtaaactggtaccagcagctcccaggaacggcccccaaactcctcatctatagtaatgatcagcggccctcaggggtccctgaccga
ttctctggctccaagtccggcacctcagcctccctggccatcagtgggctccagtctgaggatgaggctgattattactgtgcttcatgggat
gacagcctgaatggccgttatgtcttcggaactgggaccaaggtcaccgtcctaggt [SEQ ID NO: 193]

tctagaggtggtggtggtagcggcggcggcggctctggtggtggtggatccctcgagatggcc [SEQ ID NO: 305]

**caggtccagctggtacagtctggggctgaggtgaggaagcctggggcctcagtgaaggtttcctgcaagacttctggatacaccttca
gttggtatgctatacattgggtgcgccaggcccccggacaaaggcttgagtggatggatcaacgctggcaatggaaacacaa
atattcacagaaatttcagggcagagtcagtcttaccagggacacatccgcgagcacagcctacatggagctgagcagcctgagat
ctgatgacacggctgtgtattactgtgcgagaccgataattatggttcgggtggggatgttttgatatctggggccaagggacaatg
gtcaccgtctcttca [SEQ ID NO: 194]**

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSASGTPGQRVTISCSGSSSNIGSNTVNWYQQLPGTAPKLLIYSNDQRPSGVPDR
FSGSKSGTSASLAISGLQSEDEADYYCASWDDSLNGRYVFGTGTKVTVLG [SEQ ID NO:
195]

SRGGGGSGGGGSGGGGSLEMA [SEQ ID NO: 307]

**QVQLVQSGAEVRKPGASVKVSCKTSGYTFSWYAIHWVRQAPGQRLEWMGWINAG
NGNTKYSQKFQGRVSLTRDTSASTAYMELSSLRSDDTAVYYCARPDNYGSGGDVFDI
WGQGTMVTVSS [SEQ ID NO: 196]**

TSGQAGQHHHHHHGAYPYDVPDYAS [SEQ ID NO: 308]

TABLE 50

ET200-100
DNA Sequence
(light chain variable region scFv linker heavy chain variable region His tag + HA tag)
aattttatgctgactcagccccactctgtgtcggagtctccggggaagacggtaaccatctcctgcacccgcagcagtggcagcattgccag
caactttgtgcagtggtaccagcagcgcccgggcagtgccccaccctatgatctatgaggataacaacagaccccctgggtccctgat
cggttctctgcctccgtcgacagctcctccaactctgcctccctcaccatctctggactgaagactgaggacgaggctgactactactgtcagt
cttatgataccagcaatgtggtattcggcggggggaccaagctgaccgtcctaggt [SEQ ID NO: 197]

tctagaggtggtggtggtagcggcggcggcggctctggtggtggtggatccctcgagatggcc [SEQ ID NO: 305]

**gaggtgcagctggtggagtctgggggaggcttggtacagcctggagggtccctgagactctcctgtgcagcctctggattcaccttca
gtagttatgaaatgaactgggtccgccaggctccagggaaggggctggagtgggtttcatacattagtagtagtggtagtaccatat
actacgcagactctgtgaagggccgattcaccatctccagagacaacgccaagaactcactgtatctgcaaatgaacagcctgaga
gccgaggacacggctgtttattactgtgcacgctgggactacggtatggacgtctggggccaagggaccacggtcaccgtctcctca
[SEQ ID NO: 198]**

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNFVQWYQQRPGSAPTPMIYEDNNRPPGVPD
RFSASVDSSSNSASLTISGLKTEDEADYYCQSYDTSNVVFGGGTKLTVLG [SEQ ID NO:
199]

SRGGGGSGGGGSGGGGSLEMA [SEQ ID NO: 307]

**EVQLVESGGGLVQPGGSLRLSCAASGFTFSSYEMNWVRQAPGKGLEWVSYISSSGS
TIYYADSVKGRFTISRDNAKNSLYLQMNSLRAEDTAVYYCARWDYGMDVWGQGTT
VTVSS [SEQ ID NO: 200]**

TSGQAGQHHHHHHGAYPYDVPDYAS [SEQ ID NO: 308]

TABLE 51

ET200-101
DNA Sequence
(light chain variable region scFv linker heavy chain variable region His tag + HA tag)
caggctgtgctgactcagccaccctcagcgtctgggcccccgggcagagggtcaccgtctcttgttctggaagcaactccaacatcggaag
taactacgttaactggtaccagcagttcccaggaacggcccccaaactcctcatgtatagtagtagtcagcggccctcaggggtccctgaccg
attctctggctccaagtctggcacctcagcctccctggccatcagtgggctccactctgaggatgaggcgattattactgtgctacatgggatg
acagcctgaatgcttgggtgttcggcggagggaccaagctgaccgtcctaggt [SEQ ID NO: 201]

<u>tctagaggtggtggtggtagcggcggcggcggctctggtggtggtggatccctcgagatggcc</u> [SEQ ID NO: 305]

**gaggtccagctggtgcagtctggggctgaggtgaggaagcctggggcctcagtgaaggtttcctgcaagacttctggatacaccttca
cttggtatgctatacattgggtgcgccaggccccggacaaaggcttgagtggatggatggatcaacgctggcagtggaaacacaa
aatattcacagaaatttcagggcagagtcacccttaccagggacacatccgcgagcacagctacatggagctgagcagcctgaga
tctgatgacacggctgtgtattactgtgcgagacccaataactatggttcgggtggggatgttttgatatctggggccaagggacaat
ggtcaccgtctcttca** [SEQ ID NO: 202]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSASGAPGQRVTVSCSGSNSNIGSNYVNWYQQFPGTAPKLLMYSSSQRPSGVP
DRFSGSKSGTSASLAISGLHSEDEADYYCATWDDSLNAWVFGGGTKLTVLG [SEQ ID NO:
203]

<u>SRGGGGSGGGGSGGGGSLEMA</u> [SEQ ID NO: 307]

**EVQLVQSGAEVRKPGASVKVSCKTSGYTFTWYAIHWVRQAPGQRLEWMGWINAGS
GNTKYSQKFQGRVTLTRDTSASTAYMELSSLRSDDTAVYYCARPNNYGSGGDVFDI
WGQGTMVTVSS** [SEQ ID NO: 204]

TSGQAGQHHHHHGAYPYDVPDYAS [SEQ ID NO: 308]

TABLE 52

ET200-102
DNA Sequence
(light chain variable region scFv linker heavy chain variable region His tag + HA tag)
cagtctgtcgtgacgcagccgcccctcagtgtctgcggccccaggacagaaggtcaccatctcctgctctggaagcagctccaacattggga
ataattatgtatcctggtaccagcagctcccaggaacagcccccaaactcctcatttatgacaataataagcgaccctcagggattcctgaccg
attctctggctccaagtctggcacgtcagccaccctgggcatcaccggactccagactggggacgaggccgattattactgcggaacatgg
gatagcagcctgagtgcttatgtcttcggaactgggaccaaggtcaccgtcctaggt [SEQ ID NO: 205]

<u>tctagaggtggtggtggtagcggcggcggcggctctggtggtggtggatccctcgagatggcc</u> [SEQ ID NO: 305]

**caggtccagctggtgcagtctggggctgaggtgaagaagcctggggcctcagtgaaagtttcctgcaaggcttctggatacaccttc
acgaactatgctctgcattgggtgcgccaggccccggacaagggcttgagtggatggcatggatcaacggtggcaatggtaacac
aaaatattcacagaacttccagggcagagtcaccattaccagggacacatccgcgagcacagcctatatggagctgagcagcctg
agatctgaagacacggctgtgtattactgtgcgaaaccggaggaaacagctggaacaatccactttgactactggggccagggaac
cccggtcaccgtctcctca** [SEQ ID NO: 206]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSAAPGQKVTISCSGSSSNIGNNYVSWYQQLPGTAPKLLIYDNNKRPSGIPD
RFSGSKSGTSATLGITGLQTGDEADYYCGTWDSSLSAYVFGTGTKVTVLG [SEQ ID NO:
207]

<u>SRGGGGSGGGGSGGGGSLEMA</u> [SEQ ID NO: 307]

**QVQLVQSGAEVKKPGASVKVSCKASGYTFTNYALHWVRQAPGQGLEWMAWINGG
NGNTKYSQNFQGRVTITRDTSASTAYMELSSLRSEDTAVYYCAKPEETAGTIHFDY
WGQGTPVTVSS** [SEQ ID NO: 208]

TSGQAGQHHHHHGAYPYDVPDYAS [SEQ ID NO: 308]

TABLE 53

ET200-103
DNA Sequence
(light chain variable region scFv linker heavy chain variable region His tag + HA tag)
caggctgtgctgactcagccccactctgtgtcggagtctccggggaagacggtaaccatctcctgcacccgcagcagtggcagcattgcca
gcaactatgtgcagtggtaccagcagcgcccgggcagtgcccccaccactgtgatctatgaggataaccaaagaccctctggggtccctga
tcggttctctggctccatcgacagctcctccaactctgcctccctcaccatctctggactgaagactgaggacgaggctgactactactgtcag
tcttatgatagcaccatcacggtgttcggcggagggaccaagctgaccgtcctaggt [SEQ ID NO: 209]

tctagaggtggtggtggtagcggcggcggcggctctggtggtggtggatccctcgagatggcc [SEQ ID NO: 305]

**caggtccagctggtacagtctggggctgaggtgaagaagcctgggtcctcggtgaaggtctcctgcaaggcttctggaggcaccttc
agcagctatgctatcagctgggtgcgacaggcccctggacaagggcttgagtggatgggagggatcatccctatctttggtacagca
aactacgcacagaagttccagggcagagtcacgattaccgcggacgaatccacgagcacagcctacatggagctgagcagcctga
gatctgaggacacggccgtgtattactgtgcgggggagggttactatgatagtagtggttattccaacggtgatgcttttgatatctgg
ggccaagggacaatggtcaccgtctcttca** [SEQ ID NO: 210]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPHSVSESPGKTVTISCTRSSGSIASNYVQWYQQRPGSAPTTVIYEDNQRPSGVPD
RFSGSIDSSSNSASLTISGLKTEDEADYYCQSYDSTITVFGGGTKLTVLG [SEQ ID NO:
211]

SRGGGGSGGGGSGGGGSLEMA [SEQ ID NO: 307]

**QVQLVQSGAEVKKPGSSVKVSCKASGGTFSSYAISWVRQAPGQGLEWMGGIIPIFG
TANYAQKFQGRVTITADESTSTAYMELSSLRSEDTAVYYCAGEGYYDSSGYSNGDAF
DIWGQGTMVTVSS** [SEQ ID NO: 212]

TSGQAGQHHHHHGAYPYDVPDYAS [SEQ ID NO: 308]

TABLE 54

ET200-104
DNA Sequence
(light chain variable region scFv linker heavy chain variable region His tag + HA tag)
aattttatgctgactcagccccactctgtgtcggagtctccggggaagacggtaaccatctcctgcacccgcagcagtggcagcattgccag
caactatgtgcagtggtaccagcagcgcccgggcagtgcccccaccactgtgatctatgaggataaccaaagaccctctggggtccctgat
cggttctctggctccatcgacagctcctccaactctgcctccctcaccatctctggactgaagactgaggacgaggctgactactactgtcagt
cttatgatagcagcaatgtggtattcggcggagggaccaaggtcaccgtcctaggt [SEQ ID NO: 213]

tctagaggtggtggtggtagcggcggcggcggctctggtggtggtggatccctcgagatggcc [SEQ ID NO: 305]

**gaggtgcagctggtggagtctgggggaggcttggtacagcctggagggtccctgagactctcctgtgcagcctctggattcaccttca
gtagttatgaaatgaactgggtccgccaggctccagggaaggggctggagtgggtttcatacattagtagtagtggtagtaccatat
actacgcagactctgtgaagggccgattcaccatctccagagacaacgccaagaactcactgtatctgcaaatgaacagcctgaga
gccgaggacacggctgtttattactgtgcacgctgggactacggtatggacgtctggggccaagggaccacggtcaccgtctcctca**
[SEQ ID NO: 214]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSAPTTVIYEDNQRPSGVPD
RFSGSIDSSSNSASLTISGLKTEDEADYYCQSYDSSNVVFGGGTKVTVLG [SEQ ID NO:
215]

SRGGGGSGGGGSGGGGSLEMA [SEQ ID NO: 307]

**EVQLVESGGGLVQPGGSLRLSCAASGFTFSSYEMNWVRQAPGKGLEWVSYISSSGS
TIYYADSVKGRFTISRDNAKNSLYLQMNSLRAEDTAVYYCARWDYGMDVWGQGTT
VTVSS** [SEQ ID NO: 216]

TSGQAGQHHHHHGAYPYDVPDYAS [SEQ ID NO: 308]

TABLE 55

ET200-105
DNA Sequence
(light chain variable region scFv linker heavy chain variable region His tag + HA tag)
tcctatgtgctgactcagccaccctcagtgtccgtgtccccaggacagacagccagcatcacctgctctggagatagattgacgaataaatat
gtttcctggtatcaacagaagccaggccagtcccctgtgttggtcatctatgaggatgccaagcggccctcagggatccctgcgcgattctct
ggctccaactctgggaacacagccactctgaccatcagcgggacccaggctatggatgagtctgaatattactgtcaggcgtgggacagca
gtgtggtggtttttggcggagggaccaagctgaccgtcctaggt [SEQ ID NO: 217]

tctagaggtggtggtggtagcggcggcggcggctctggtggtggtggatccctcgagatggcc [SEQ ID NO: 305]

**gaggtgcagctggtggagtctgggggaggcttggtacagcctggcaggtccctgagactctcctgtgcagcctctggatttacctttg
atgattatgccatgcactgggtccggcaagctccagggaagggcctggagtgggtctcaggtattagttggaatagtggtagtatag
gctatgcggactctgtgaagggccgattcaccatctccagagacaacgccaagaactccctgtatctgcaaatgaacagtctgaga
gatgaggacacggccttgtattactgtgcaaaagaccgaggggggggagttatcgttaaggatgcttttgatatctggggccaaggg
acaatggtcaccgtctcttca [SEQ ID NO: 218]**

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVSPGQTASITCSGDRLTNKYVSWYQQKPGQSPVLVIYEDAKRPSGIPARF
SGSNSGNTATLTISGTQAMDESEYYCQAWDSSVVVFGGGTKLTVLG [SEQ ID NO: 219]

SRGGGGSGGGGSGGGGSLEMA [SEQ ID NO: 307]

**EVQLVESGGGLVQPGRSLRLSCAASGFTFDDYAMHWVRQAPGKGLEWVSGISWNS
GSIGYADSVKGRFTISRDNAKNSLYLQMNSLRDEDTALYYCAKDRGGGVIVKDAFDI
WGQGTMVTVSS [SEQ ID NO: 220]**

TSGQAGQHHHHHHGAYPYDVPDYAS [SEQ ID NO: 308]

TABLE 56

ET200-106
DNA Sequence
(light chain variable region scFv linker heavy chain variable region His tag + HA tag)
tcctatgagctgactcagccaccccgcagcgtctgggaccccggacagagagtcaccatctcttgttctgggggcgtctccaacatcgggagt
ggtgctctaaattggtaccagcaactcccaggaacggccccaaactcctcatctatagttacaatcagcggccctcaggggtctctgaccgat
tctctggctccaggtctgccacctcagcctccctggccatcagtgggctccagtctgaggatgaggctgattattactgtgcaacctgggatgat
agtgtgaatggttgggtgttcggcggagggaccaagctgaccgtcctaggt [SEQ ID NO: 221]

tctagaggtggtggtggtagcggcggcggcggctctggtggtggtggatccctcgagatggcc [SEQ ID NO: 305]

**gaggtgcagctggtggagtctggagctgaggtgaagaagcctggggattcagtgaaggtctcctgcaagccttctggttacaatttttct
caactatggtatcaactgggtgcgacaggcccctggacaagggcttgagtggatgggatggattagcacttacaccggtaacacaaa
ctatgcacagaagctgcagggcagagtcaccttcaccacagacacatccacgagcacagcctacatggagatgaggagcctgagat
ctgacgacacggccgtgtattactgtgcgcgccagcagggtggtggttggtacgatgtttggggtcaaggtactctggtcaccgtctcc
tca [SEQ ID NO: 222]**

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYELTQPPAASGTPGQRVTISCSGGVSNIGSGALNWYQQLPGTAPKLLIYSYNQRPSGVSD
RFSGSRSATSASLAISGLQSEDEADYYCATWDDSVNGWVFGGGTKLTVLG [SEQ ID NO:
223]

SRGGGGSGGGGSGGGGSLEMA [SEQ ID NO: 307]

**EVQLVESGAEVKKPGDSVKVSCKPSGYNFLNYGINWVRQAPGQGLEWMGWISTYT
GNTNYAQKLQGRVTFTTDTSTSTAYMEMRSLRSDDTAVYYCARQQGGGWYDVWG
QGTLVTVSS [SEQ ID NO: 224]**

TSGQAGQHHHHHHGAYPYDVPDYAS [SEQ ID NO: 308]

TABLE 57

ET200-107
DNA Sequence
(light chain variable region scFv linker heavy chain variable region His tag + HA tag)
cagtctgtcgtgacgcagccgcccctcagtgtctgcggccccaggagagaaggtcaccatctcctggctctggaagcaacttcaatgttgaaat
aatgatgtatcctggtatcagcaactcccaggtgcagccccaaactcctcatttatgacaataataagcgaccctcagggattcctgaccgatt
ctctggctccaagtctggcacgtcagccaccctggacatcaccgggctccacagtgacgacgaggccgattattactgcggaacatgggata
gcagcctgaatactggggggtcttcggaactgggaccaaggtcaccgtcctaggt [SEQ ID NO: 225]

<u>tctagaggtggtggtggtagcggcggcggcggctctggtggtggtggatccctcgagatggcc</u> [SEQ ID NO: 305]

**gaggtccagctggtgcagtctggagctgaggtgaagaagcctggggcctcagtgaaggtctcctgcaaggcttctggttacaccttta
ccagctatactatcagctgggtacgacaggcccctggacaagggcttgagtggatgggatggatcagcacttacaatggtctcacaa
actatgcacagaacctccagggcagagtcaccatgactacagacacattcacgaccacagcctacatggagctgaggagcctcaga
tctgacgacacggccgtgtattactgtgtgagagaggggtccccgactacggtgacttcgcgtcctttgactactggggccagggaa
ccctggtcaccgtctcctca** [SEQ ID NO: 226]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSAAPGEKVTISCSGSNFNVGNNDVSWYQQLPGAAPKLLIYDNNKRPSGIPD
RFSGSKSGTSATLDITGLHSDDEADYYCGTWDSSLNTGGVFGTGTKVTVLG [SEQ ID NO: 227]

<u>SRGGGGSGGGGSGGGGSLEMA</u> [SEQ ID NO: 307]

**EVQLVQSGAEVKKPGASVKVSCKASGYTFTSYTISWVRQAPGQGLEWMGWISTYNG
LTNYAQNLQGRVTMTTDTFTTTAYMELRSLRSDDTAVYYCVREGSPDYGDFASFDY
WGQGTLVTVSS** [SEQ ID NO: 228]

TSGQAGQHHHHHGAYPYDVPDYAS [SEQ ID NO: 308]

TABLE 58

ET200-108
DNA Sequence
(light chain variable region scFv linker heavy chain variable region His tag + HA tag)
cagtctgtgttgacgcagccgcccctcagtgtctgcgcccccgggacagaaggtcaccatctcctgctctggaagcagctccaacattgggaat
aattatgtatcctggtaccagcagttcccaggaacagcccccaaactcctcatttatgacaataataagcgaccctcagggatttctgaccgatt
ctctggctccaagtctggcacgtcagccaccctgggcatcgccggactccagactggggacgaggccgattattactgcggaacatgggatac
cagcctgagtggttttttatgtcttcggaagtgggaccaaggtcaccgtcctaggt [SEQ ID NO: 229]

<u>tctagaggtggtggtggtagcggcggcggcggctctggtggtggtggatccctcgagatggcc</u> [SEQ ID NO: 305]

**gaggtccagctggtacagtctggagctgaggtgaagaagcctggggcctcagtgaaggtctcctgcaaggcttctggttacaccttta
ccagctatactatcagctgggtacgacaggcccctggacaagggcttgagtggatgggatggatcagcacttacaatggtctcacaa
actatgcacagaacctccagggcagagtcaccatgactacagacacattcacgaccacagcctacatggagctgaggagcctcaga
tctgacgacacggccgtgtattactgtgtgagagaggggtccccgactacggtgacttcgcgtcctttgactactggggccagggaa
ccctggtcaccgtctcctca** [SEQ ID NO: 230]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSAPPGQKVTISCSGSSSNIGNNYVSWYQQFPGTAPKLLIYDNNKRPSGISDR
FSGSKSGTSATLGIAGLQTGDEADYYCGTWDTSLSGFYVFGSGTKVTVLG [SEQ ID NO: 231]

<u>SRGGGGSGGGGSGGGGSLEMA</u> [SEQ ID NO: 307]

**EVQLVQSGAEVKKPGASVKVSCKASGYTFTSYTISWVRQAPGQGLEWMGWISTYNG
LTNYAQNLQGRVTMTTDTFTTTAYMELRSLRSDDTAVYYCVREGSPDYGDFASFDY
WGQGTLVTVSS** [SEQ ID NO: 232]

TSGQAGQHHHHHGAYPYDVPDYAS [SEQ ID NO: 308]

TABLE 59

ET200-109
DNA Sequence
(light chain variable region scFv linker heavy chain variable region His tag + HA tag)
ctgcctgtgctgactcagccaccctcagcgtctgcgaccccgggcagagggtcaccatctcttgttctggaaccacctccaacatcggaagt
aatactgtacactggtaccagcagctcccagggacggccccaaactcctcatctataataataatcagcggccctcaggggtccctgaccga
ttctctggctccaagtctggcacctcagcctccctggccatcagtgggctccggtccgaggatgaggctacatattcctgtgcaacatgggatg
acagcctgagtggtgtggtcttcggcggagggaccaagctgaccgtcctaggt [SEQ ID NO: 233]

tctagaggtggtggtggtagcggcggcggcggctctggtggtggtggatccctcgagatggcc [SEQ ID NO: 305]

**gaggtccagctggtgcagtctggggctgaggtgaagaagcctggggtcctcggtgaaggtctcctgcaaggcttctgga ggcaccttca
gcagctatgctatcagctgggtgcgacaggcccctggacaagggcttgagtggatgggagggatcatccctatctttggtacagcaa
actacgcacagaagttccagggcagagtcacgattaccgcggacgaatccacgagcacagcctacatggagctgagcagcctgag
atctgaggacacggccgtgtattactgtgcgagagatcccgcctacggtgactacgagtatgatgcttttgatatctgggggccaaggg
acaatggtcaccgtctcttca** [SEQ ID NO: 234]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
LPVLTQPPSASATPGQRVTISCSGTTSNIGSNTVHWYQQLPGTAPKLLIYNNNQRPSGVPD
RFSGSKSGTSASLAISGLRSEDEATYSCATWDDSLSGVVFGGGTKLTVLG [SEQ ID NO:
235]

SRGGGGSGGGGSGGGGSLEMA [SEQ ID NO: 307]

**EVQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARDPAYGDYEYDAFDIWG
QGTMVTVSS** [SEQ ID NO: 236]

TSGQAGQHHHHHGAYPYDVPDYAS [SEQ ID NO: 308]

TABLE 60

ET200-110
DNA Sequence
(light chain variable region scFv linker heavy chain variable region His tag + HA tag)
cagtctgtgttgacgcagccgccctcagcgtctgggaccccgggcagagggtcaccatctcttgttctggaagcagctccaacatcggaact
aatggtgtaaactggttccagcagttcccaggaacggcccccaaactcctcatctatactaatgatcagcggccctcaggggtccctgaccgat
tctctggctccaagtctggcacctcagcctccctggccatcagtgggctccagtctgcggatgaggctgattattactgtgcagtgtgggacca
cagcctgaatggtccggtgttcggcggagggaccaagctgaccgtcctaggt [SEQ ID NO: 237]

tctagaggtggtggtggtagcggcggcggcggctctggtggtggtggatccctcgagatggcc [SEQ ID NO: 305]

**caggtgcagctggtgcagtctggggctgaggtgaagaagcctggggtcctcggtgaaggtctcctgcaaggcttctggaggcaccttca
gcagctatgctatcagctgggtgcgacaggcccctggacaagggcttgagtggatgggagggatcatccctatctttggtacagcaa
actacgcacagaagttccagggcagagtcacgattaccgcggacgaatccacgagcacagcctacatggagctgagcagcctgag
atctgaggacacggccgtgtattactgtgcgagaggggccggttttgatgcttttgatatctgggggccaagggacaatggtcaccgtct
cttca** [SEQ ID NO: 238]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSASGTPGQRVTISCSGSSSNIGTNGVNWFQQFPGTAPKLLIYTNDQRPSGVPDR
FSGSKSGTSASLAISGLQSADEADYYCAVWDHSLNGPVFGGGTKLTVLG [SEQ ID NO:
239]

SRGGGGSGGGGSGGGGSLEMA [SEQ ID NO: 307]

**QVQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARGAGFDAFDIWGQGTM
VTVSS** [SEQ ID NO: 240]

TSGQAGQHHHHHGAYPYDVPDYAS [SEQ ID NO: 308]

TABLE 61

ET200-111
DNA Sequence
(light chain variable region scFv linker heavy chain variable region His tag + HA tag)
caggctgtgctgactcagccacccctcagcgtctgggaccccccgggcagagggtcaccatctcttgttctggaagcagctccaacatcggaa
gtaatactgtaaactggtaccagcagctcccaggaacggcccccaaactcctcatctatagtaataatcagcggccctcaggggtccctgac
cgattctctggctccaagtctggcacctcagcctccctggccatcagtgggctccagtctgaggatgagactgattattactgtgcagcatggg
atgacagcctgaatggttatgtcttcggaactgggaccaaggtcaccgtcctaggt [SEQ ID NO: 241]

tctagaggtggtggtggtagcggcggcggcggctctggtggtggtggatccctcgagatggcc [SEQ ID NO: 305]

**caggtgcagctacagcagtggggcgcaggactgttgaagccttcggagaccctgtccctcacctgcgctgtctatggtgggtccttca
gtggttactactggagctggatccgccagccccagggaaggggctggagtggattgggaaatcaatcatagtggaagcaccaa
ctacaacccgtccctcaagagtcgagtcaccatatcagtagacacgtccaagaaccagttctccctgaagctgagctctgtgaccgc
cgcggacacggctgtgtattactgtgcgagagaggggctagatgcttttgatatctggggccaagggacaatggtcaccgtctcttca**
[SEQ ID NO: 242]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSASGTPGQRVTISCSGSSSNIGSNTVNWYQQLPGTAPKLLIYSNNQRPSGVPD
RFSGSKSGTSASLAISGLQSEDETDYYCAAWDDSLNGYVFGTGTKVTVLG [SEQ ID NO: 243]

SRGGGGSGGGGSGGGGSLEMA [SEQ ID NO: 307]

**QVQLQQWGAGLLKPSETLSLTCAVYGGSFSGYYWSWIRQPPGKGLEWIGEINHSGS
TNYNPSLKSRVTISVDTSKNQFSLKLSSVTAADTAVYYCAREGLDAFDIWGQGTMVT
VSS** [SEQ ID NO: 244]

TSGQAGQHHHHHGAYPYDVPDYAS [SEQ ID NO: 308]

TABLE 62

ET200-112
DNA Sequence
(light chain variable region scFv linker heavy chain variable region His tag + HA tag)
caggctgtgctgactcagccacccctcagcgtctgggaccccgggcagagggtcaccatctcttgttctggaagcagctccaacatcggaag
taatactgtaaactggtaccagcagctcccaggaacggcccccaaactcctcatgtatagtaatgatcagcggccctcaggggtccctgaccg
attctctggctccaagtctggcacctcagcctccctggccatcagtgggctccagtctgaggatgaggctgattattattgtgcagcatgggatg
acagcctgaatggttatgtcttcgcagctgggacccagctcaccgttttaagt [SEQ ID NO: 245]

tctagaggtggtggtggtagcggcggcggcggctctggtggtggtggatccctcgagatggcc [SEQ ID NO: 305]

**caggtgcagctacagcagtggggcgcaggactgttgaagccttcggagaccctgtccctcacctgcgctgtctatggtgggtccttca
gtggttactactggagctggatccgccagccccagggaaggggctggagtggattgggaaatcaatcatagtggaagcaccaac
tacaacccgtccctcaagagtcgagtcaccatatcagtagacacgtccaagaaccagttctccctgaagctgagctctgtgaccgccg
cggacacggctgtgtattactgtgcgagagaggggctagatgcttttgatatctggggccaagggacaatggtcaccgtctcttca**
[SEQ ID NO: 246]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSASGTPGQRVTISCSGSSSNIGSNTVNWYQQLPGTAPKLLMYSNDQRPSGVPD
RFSGSKSGTSASLAISGLQSEDEADYYCAAWDDSLNGYVFAAGTQLTVLS [SEQ ID NO: 247]

SRGGGGSGGGGSGGGGSLEMA [SEQ ID NO: 307]

**QVQLQQWGAGLLKPSETLSLTCAVYGGSFSGYYWSWIRQPPGKGLEWIGEINHSGS
TNYNPSLKSRVTISVDTSKNQFSLKLSSVTAADTAVYYCAREGLDAFDIWGQGTMVT
VSS** [SEQ ID NO: 248]

TSGQAGQHHHHHGAYPYDVPDYAS [SEQ ID NO: 308]

TABLE 63

ET200-113
DNA Sequence
(light chain variable region scFv linker heavy chain variable region His tag + HA tag)
cagtctgtcgtgacgcagccgcccctcagtgtctgcgccccaggacagaaggtcaccatctcctgctctggaagcagctccaacattgggaa
taattatgtatcctggtaccagcagctcccaggaacagcccccaaactcctcatttatgacaataataagcgaccctcagggattcctgaccgat
tctctggctccaagtctggcacgtcagccaccctgggcatcactggactccagactggggacgaggccgattattactgcggaacatgggata
gcagcctgagtgctgcttatgtcttcggaactgggaccaaggtcaccgtcctaggt [SEQ ID NO: 249]

<u>tctagaggtggtggtggtagcggcggcggcggctctggtggtggtggatccctcgagatggcc</u> [SEQ ID NO: 305]

**caggtccagctggtacagtctggagctgaggtgaagaagcctggggcctcagtgaaggtctcctgcaaggcttctggttacagcttta
ccagctatactatcagctgggttcgacaggcccctggacaaggccttgagtggatgggatgggtcagcacttacaatggtctcagaaa
ctatgcacagaacctccagggcagagtcaccatgactacagacacactcacgaccacagcctacatggagctgaggagcctcagat
ctgacgacacggccgtgtattattgtgagagagggtcccccgactacggtgacttcgcggcctttgactactggggccagggcac
cctggtcaccgtctcctca** [SEQ ID NO: 250]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVVTQPPSVSAAPGQKVTISCSGSSSNIGNNYVSWYQQLPGTAPKLLIYDNNKRPSGIPD
RFSGSKSGTSATLGITGLQTGDEADYYCGTWDSSLSAAYVFGTGTKVTVLG [SEQ ID NO:
251]

<u>SRGGGGSGGGGSGGGGSLEMA</u> [SEQ ID NO: 307]

**QVQLVQSGAEVKKPGASVKVSCKASGYSFTSYTISWVRQAPGQGLEWMGWVSTYN
GLRNYAQNLQGRVTMTTDTLTTTAYMELRSLRSDDTAVYYCVREGSPDYGDFAAFD
YWGQGTLVTVSS** [SEQ ID NO: 252]

TSGQAGQHHHHHHGAYPYDVPDYAS [SEQ ID NO: 308]

TABLE 64

ET200-114
DNA Sequence
(light chain variable region scFv linker heavy chain variable region His tag + HA tag)
caggctgtgctgactcagccaccctcagcgtctgagaccccggggcagagggtcaccatctcttgttctggaagcaggtccaacatcggaac
taatattgtacactggtaccagcagcgcccaggaatggccccaaactcctcacttatggtagtcggcggccctcagggtcccggaccgatt
ctctggctccaagtttggcacctcagcctccctggccatcagtgggctccagtctgaggatgaggctgattattattgtgcagcatgggatgaca
gtctgaatggtccggctttcggcggagggaccaagctgaccgtcctaggt [SEQ ID NO: 253]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtccctcacctgcgctgtctatggtgggtccttca
gtggttactactggagctggatccgccagcccccagggaaggggctggagtggattgggaaatcaatcatagtggaagcaccaac
tacaacccgtccctcaagagtcgagtcaccatatcagtagacacgtccaagaaccagttctccctgaagctgagctctgtgaccgcg
cggacacggctgtgtattactgtgcgagagacggtgggggctactttgactactggggccagggaaccctggtcaccgtctcctca**
[SEQ ID NO: 254]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSASETPGQRVTISCSGSRSNIGTNIVHWYQQRPGMAPKLLTYGSRRPSGVPDR
FSGSKFGTSASLAISGLQSEDEADYYCAAWDDSLNGPAFGGGTKLTVLG [SEQ ID NO:
255]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEINHSGS
TNYNPSLKSRVTISVDTSKNQFSLKLSSVTAADTAVYYCARDGGGYFDYWGQGTLVT
VSS** [SEQ ID NO: 256]

TSGQAGQHHHHHHGAYPYDVPDYAS [SEQ ID NO: 308]

TABLE 65

ET200-115
DNA Sequence
(light chain variable region scFv linker heavy chain variable region His tag + HA tag)
cagtctgtgttgacgcagccgccctcagtgtctggggcccccaggcagagggtcaccatctcctgcactgggagcagctccaatatcgggg
cacgttatgatgtacactggtaccagcaactcccaggaacagcccccgactcctcatctctgctaactacgatcggccctcaggggtccctga
ccgattctctggctccaagtctggcacctcagcccctggccatcactgggctccaggctgaggatgaggctgattattactgccagtcctatg
acagcagtgtgagtgcttgggtgttcggcggagggaccaaggtcaccgtcctaggt [SEQ ID NO: 257]

<u>tctagaggtggtggtggtagcggcggcggcggctctggtggtggtggatccctcgagatggcc</u> [SEQ ID NO: 305]

**gaagtgcagctggtgcagtctggggctgaagtgaaggagcctggggcctcagtgaggatctcctgccaggcatctggatacaacttc
atcagttattatatgcactgggtgcggcaggcccctgggcaaggtcttgagtggatgggcaccatcaacccaggcagtggtgagaca
gactactcacagaagttgcagggcagagtcaccatgaccagggacccgtccacgggtacattcgacatgggcctgagcagctgac
atctggggacacggccgtctattattgtgcgacaggtctcatcagaggagctagcgatgcttttaatatctggggccggggggacaatg
gtcaccgtctcttca** [SEQ ID NO: 258]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSSSNIGARYDVHWYQQLPGTAPRLLISANYDRPSGVP
DRFSGSKSGTSASLAITGLQAEDEADYYCQSYDSSVSAWVFGGGTKVTVLG [SEQ ID NO: 259]

<u>SRGGGGSGGGGSGGGGSLEMA</u> [SEQ ID NO: 307]

**EVQLVQSGAEVKEPGASVRISCQASGYNFISYYMHWVRQAPGQGLEWMGTINPGSG
ETDYSQKLQGRVTMTRDPSTGTFDMGLSSLTSGDTAVYYCATGLIRGASDAFNIWG
RGTMVTVSS** [SEQ ID NO: 260]

TSGQAGQHHHHHGAYPYDVPDYAS [SEQ ID NO: 308]

TABLE 66

ET200-116
DNA Sequence
(light chain variable region scFv linker heavy chain variable region His tag + HA tag)
cagcctgtgctgactcagccaccctcagtgtccgtgtccccaggacagacgccgccatcccctgttctggagataagttggggatatttt
gcttcctggtatcagcagaagccaggccagtcccctgtgctggtcatctatcaagatactaagcggccctcaggggatccctgagcgattctctg
gctccaactctgggaacacagccactctgaccatcagcgggacccaggctatggatgaggctgactattactgtcagacgtgggccagcgg
cattggtggttcggcggagggaccaagctgaccgtcctaggt [SEQ ID NO: 261]

<u>tctagaggtggtggtggtagcggcggcggcggctctggtggtggtggatccctcgagatggcc</u> [SEQ ID NO: 305]

**caggtacagctgcagcagtcaggtccaggactggtgaagccctcgcagaccctctcactcacctgtgccatctccggggacagtgtctct
ctagcaacagtgctgcttggaactggatcaggcagtccccatcgagaggccttgagtggctgggaaggacatactacaggtccaagt
ggtataatgattatgcagtatctgtgaaaagtcgaataaccatcaacccagacacatccaagaaccagttctccctgcagctgaactc
tgtgactccgaggacacggctgtgtattactgtgcaagagagcgcagtggctggaagggatttgactactggggccagggaaccct
ggtcaccgtctcctca** [SEQ ID NO: 262]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QPVLTQPPSVSVSPGQTAAIPCSGDKLGDKFASWYQQKPGQSPVLVIYQDTKRPSGIPERF
SGSNSGNTATLTISGTQAMDEADYYCQTWASGIVVFGGGTKLTVLG [SEQ ID NO: 263]

<u>SRGGGGSGGGGSGGGGSLEMA</u> [SEQ ID NO: 307]

**QVQLQQSGPGLVKPSQTLSLTCAISGDSVSSNSAAWNWIRQSPSRGLEWLGRTYYRS
KWYNDYAVSVKSRITINPDTSKNQFSLQLNSVTPEDTAVYYCARERSGWKGFDYWG
QGTLVTVSS** [SEQ ID NO: 264]

TSGQAGQHHHHHGAYPYDVPDYAS [SEQ ID NO: 308]

TABLE 67

ET200-117
DNA Sequence
(light chain variable region scFv linker heavy chain variable region His tag + HA tag)
gatgttgtgatgactcagtctctccaccctgtccgtcacccctggagagccggcctccatcacctgcaggtctagtcagagcctcctggaa
agaaatgcatacaactacttggattggtacctgcagaggccaggacagtctccacagctcctgatctacttgggttctaatcgggccgcggg
gtccctgacaggttcagtggcagtggatcaggcagagattttacactgaaaatcagcagagtggagcctgaggatgttgggtttattactgc
atgcaagctctacaagctccgttcactttcggcggagggaccaaggtggagatcaaacgt [SEQ ID NO: 265]

<u>tctagaggtggtggtggtagcggcggcggcggctctggtggtggtggatccctcgagatggcc</u> [SEQ ID NO: 305]

**gaagtgcagctggtgcagtctgggggaggcttggtacagcctggggggtccctgagactctcctgtgcagcctctggattcacctttta
gcagctatgccatgagctgggtccgccaggctccaggaaggggctggagtgggtctcagctattagtggtagtggtggtagcaca
tactacgcagactccgtgaagggccggttcaccatctccagagacaattccaagaacacgctgtatctgcaaatgaacagcctgag
agccgaggacacggccgtatattactgtgcgaaatgggggcccgtttcaggatgcttttgatatctggggccaagggacaatggtcac
cgtctcttca** [SEQ ID NO: 266]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
DVVMTQSPPSLSVTPGEPASITCRSSQSLLERNAYNYLDWYLQRPGQSPQLLIYLGSNRA
AGVPDRFSGSGSGRDFTLKISRVEPEDVGVYYCMQALQAPFTFGGGTKVEIKR [SEQ ID
NO: 267]

<u>SRGGGGSGGGGSGGGGSLEMA</u> [SEQ ID NO: 307]

**EVQLVQSGGGLVQPGGSLRLSCAASGFTFSSYAMSWVRQAPGKGLEWVSAISGSGG
STYYADSVKGRFTISRDNSKNTLYLQMNSLRAEDTAVYYCAKWGPFQDAFDIWGQ
GTMVTVSS** [SEQ ID NO: 268]

TSGQAGQHHHHHHGAYPYDVPDYAS [SEQ ID NO: 308]

TABLE 68

ET200-118
DNA Sequence
(light chain variable region scFv linker heavy chain variable region His tag + HA tag)
caggctgtgctgactcagcctgcctccgtgtctgggtctcctggacagtcgatcaccatctcctgcactggaaccagcagtgacgttggtgtt
ataactatgtcctggtaccaacagcacccgggcaaagcccccaaactcatgatttatgaggtcagtaatcggccctcaggggtttctaatcgc
ttctctggctccaagtctggcaacacggcctccctgaccatctctggctccaggctgaggacgaggctgattattactgcagctcatatacaag
cagcagcacccttatgtcttcggagcagggaccaaggtcaccgtcctaggt [SEQ ID NO: 269]

<u>tctagaggtggtggtggtagcggcggcggcggctctggtggtggtggatccctcgagatggcc</u> [SEQ ID NO: 305]

**gaggtgcagctggtggagtctgggggaggcttggtacagcctggcaggtccctgagactctcctgtgcagcctctggattcacctttga
tgattatgccatgcactgggtccggcaagctccagggaagggcctggagtgggtctcaggtattagttggaatagtggtagcataggc
tatgcggactctgtgaagggccgattcaccatctccagagacaacgccaagaactccctgtatctgcaaatgaacagtctgagagctg
aggacacggccttgtattactgtgcaaaagccaggtggacagcagtggcatcagaccaccactttgactactggggccagggaacg
ctggtcaccgtctcctca** [SEQ ID NO: 270]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPASVSGSPGQSITISCTGTSSDVGGYNYVSWYQQHPGKAPKLMIYEVSNRPSGV
SNRFSGSKSGNTASLTISGLQAEDEADYYCSSYTSSSTPYVFGAGTKVTVLG [SEQ ID NO:
271]

<u>SRGGGGSGGGGSGGGGSLEMA</u> [SEQ ID NO: 307]

**EVQLVESGGGLVQPGRSLRLSCAASGFTFDDYAMHWVRQAPGKGLEWVSGISWNS
GSIGYADSVKGRFTISRDNAKNSLYLQMNSLRAEDTALYYCAKARWTAVASDHHFD
YWGQGTLVTVSS** [SEQ ID NO: 272]

TSGQAGQHHHHHHGAYPYDVPDYAS [SEQ ID NO: 308]

TABLE 69

ET200-119
DNA Sequence
(light chain variable region scFv linker heavy chain variable region His tag + HA tag)
caggctgtgcttactcagccaccctcagcgtctgggaccccccgggcagagggtcaccatctcttgttctggaagcagctccaacatcggaagt
aatactgtaaactggtaccagcagctcccaggaacggcccccaaactcctcatctatagtaataatcagcggccctcaggggtccctgaccga
ttctctggctccaagtctggcacctcagcctcctggccatcagtgggctccagtctgaggatgaggctgattattactgtgcagcatgggatga
cagcctgaatggttatgtcttcggaactgggaccaagctgaccgtcctaggt [SEQ ID NO: 273]

<u>tctagaggtggtggtggtagcggcggcggcggctctggtggtggtggatccctcgagatggcc</u> [SEQ ID NO: 305]

**gaggtgcagctggtgcagtctggggctgaggtgaagaagcctgggtcctcggtgaaggtctcctgcaaggcttctggaggcaccttc
agcagctatgctatcagctgggtgcgacaggcccctggacaagggcttgagtggatgggagggatcatccctatctttggtacagca
aactacgcacagaagttccagggcagagtcacgattaccgcggacgaatccacgagcacagcctacatggagctgagcagcctga
gatctgaggacacggccgtgtattactgtgcgagagattgggactacatggacgtctggggcaaagggaccacggtcaccgtctcct
ca** [SEQ ID NO: 274]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSASGTPGQRVTISCSGSSSNIGSNTVNWYQQLPGTAPKLLIYSNNQRPSGVPD
RFSGSKSGTSASLAISGLQSEDEADYYCAAWDDSLNGYVFGTGTKLTVLG [SEQ ID NO:
275]

<u>SRGGGGSGGGGSGGGGSLEMA</u> [SEQ ID NO: 307]

**VQLVQSGAEVKKPGSSVKVSCKASGGTFSSYAISWVRQAPGQGLEWMGGIIPIFGT
ANYAQKFQGRVTITADESTSTAYMELSSLRSEDTAVYYCARDWDYMDVWGKGTTV
TVSS** [SEQ ID NO: 276]

TSGQAGQHHHHHHGAYPYDVPDYAS [SEQ ID NO: 308]

TABLE 70

ET200-120
DNA Sequence
(light chain variable region scFv linker heavy chain variable region His tag + HA tag)
tcctatgagctgactcagccaccctcagcgtctgggaccccggggcagagggtcaccatctcttgttctggaagcagctccaacatcggaagt
aatactgtaaactggtaccagcagctcccaggaacggcccccaaactcctcatctatagtaataatcagcggccctcaggggtccctgaccga
ttctctggctccaagtctggcacctcagcctcctggccatcagtgggctccagtctgaggatgaggctgattattactgtgcagcatgggatga
cagcctgaatggttatgtcttcggaactgggaccaagctgaccgtcctaggt [SEQ ID NO: 277]

<u>tctagaggtggtggtggtagcggcggcggcggctctggtggtggtggatccctcgagatggcc</u> [SEQ ID NO: 305]

**gaggtgcagctggtggagtctggagctgaggtgaagaagcctggggcctcagtgaaggtctcctgcaaggcttctggttacaccttta
ccagctatggtatcagctgggtgcgacaggcccctggacaagggcttgagtggatgggatggatcagcgcttacaatggtaacacaa
actatgcacagaagctccagggcagagtcaccatgaccacagacacatccacgagcacagcctacatggagctgaggagcctgag
atctgacgacacggccgtgtattactgtgcgagagacctatctcggggagctaacccgcattactactactacggtatggacgtct
ggggccaagggaccacggtcaccgtctcctca** [SEQ ID NO: 278]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYELTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKVTVLG [SEQ ID NO:
279]

<u>SRGGGGSGGGGSGGGGSLEMA</u> [SEQ ID NO: 307]

**EVQLVESGAEVKKPGASVKVSCKASGYTFTSYGISWVRQAPGQGLEWMGWISAYN
GNTNYAQKLQGRVTMTTDTSTSTAYMELRSLRSDDTAVYYCARDLSRGANPHYYYY
YGMDVWGQGTTVTVSS** [SEQ ID NO: 280]

TSGQAGQHHHHHHGAYPYDVPDYAS [SEQ ID NO: 308]

TABLE 71

ET200-121
DNA Sequence
(light chain variable region scFv linker heavy chain variable region His tag + HA tag)
cagtctgtgttgacgcagccgccctcagtgtctggggcccccagggcagagggtcaccgtctcctgcactgggagcagatccaacatcgggg
caggatatgatgtacactggtaccagcaacttccaggaacagccccaaactcctcatctatggaaatagtaatcggcctccagggtccctg
accgattctctgggtctaagtctggcacctcagcctcctggtcatcactgggctccaggctgaggatgccgctgattattactgccagtcctat
gacaacactgtgcgtgaatcacccttatgtcttcggaactgggaccaaggtcaccgtcctaggt [SEQ ID NO: 281]

<u>tctagaggtggtggtggtagcggcggcggcggctctggtggtggtggatccctcgagatggcc</u> [SEQ ID NO: 305]

**gaggtccagctggtacagtctggggctgaggtgaagaagcctggggcctcagtgaaggtctcctgcaaggtttccggatacaccctc
actgaattatccatgcactgggtgcgacaggctcctggaaaaggccttgagtggatgggaggttttgatcctgaagatggtgaaaca
atctacgcacagaagttccagggcagagtcaccatgaccgaggacacatctacagacacagcctacatggagctgagcagctgag
atctgaggacacggccgtgtattactgtgcaacagagagtaatttagtgtcccggcactactactactacggtatggacgtctggggcc
aagggaccacggtcaccgtctcctca** [SEQ ID NO: 282]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QSVLTQPPSVSGAPGQRVTVSCTGSRSNIGAYDVHWYQQLPGTAPKLLIYGNSNRPPGV
PDRFSGSKSGTSASLVITGLQAEDAADYYCQSYDNTVRESPYVFGTGTKVTVLG [SEQ ID
NO: 283]

<u>SRGGGGSGGGGSGGGGSLEMA</u> [SEQ ID NO: 307]

**EVQLVQSGAEVKKPGASVKVSCKVSGYTLTELSMHWVRQAPGKGLEWMGGFDPE
DGETIYAQKFQGRVTMTEDTSTDTAYMELSSLRSEDTAVYYCATESNLVSRHYYYYG
MDVWGQGTTVTVSS** [SEQ ID NO: 284]

TSGQAGQHHHHHGAYPYDVPDYAS [SEQ ID NO: 308]

TABLE 72

ET200-122
DNA Sequence
(light chain variable region scFv linker heavy chain variable region His tag + HA tag)
ctgcctgtgctgactcagccaccctcagcgtctgggaccccgggcagagggtcaccatctcttgttctggaaccagctccaacatcggaag
taattctgtagactggtaccagcagctcccaggaacggcccccaaactcctcatctatagtaataatcagcggccctcaggggtccctgaccg
aatctctggctccaagtctggcacctcagcctccctggccatcagtgggctccagtctgaggatgaggctgattattactgtgcagcatgggat
gacagcctgaatggttatgtcttcggaactgggaccaaggtcaccgtcctaggt [SEQ ID NO: 285]

<u>tctagaggtggtggtggtagcggcggcggcggctctggtggtggtggatccctcgagatggcc</u> [SEQ ID NO: 305]

**gaagtgcagctggtgcagtctggggctgaggtgaagaagcctggggcctcagtgaaggtctcctgcaaggcttctggatacaccttc
accggctactatatgcactgggtgcgacaggcccctggacaaggccttgagtggatgggatggatcaacccaacagtggtggcac
aaactatgcacagaagtttcagggcagggtcaccatgaccagggacacgtccatcagcacagcctacatggagctgagcaggctg
agatctgacgacacggccgtgtattactgtgcgagagattacggatactatggttcggggagttattcgagcggccccctttactact
actacggtatggacgtctgggggccaagggaccacggtcaccgtctcctca** [SEQ ID NO: 286]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
LPVLTQPPSASGTPGQRVTISCSGTSSNIGSNSVDWYQQLPGTAPKLLIYSNNQRPSGVPD
RISGSKSGTSASLAISGLQSEDEADYYCAAWDDSLNGYVFGTGTKVTVLG [SEQ ID NO:
287]

<u>SRGGGGSGGGGSGGGGSLEMA</u> [SEQ ID NO: 307]

**EVQLVQSGAEVKKPGASVKVSCKASGYTFTGYYMHWVRQAPGQGLEWMGWINP
NSGGTNYAQKFQGRVTMTRDTSISTAYMELSRLRSDDTAVYYCARDYGYYGSGSYS
SGPLYYYYGMDVWGQGTTVTVSS** [SEQ ID NO: 288]

TSGQAGQHHHHHGAYPYDVPDYAS [SEQ ID NO: 308]

TABLE 73

ET200-123
DNA Sequence
(light chain variable region scFv linker heavy chain variable region His tag + HA tag)
caggctgtgctgactcagccaccctcagcgtctgggaccccgggcagagggtcaccatctcttgttctggaagcagctccaacatcggaa
gtaatactgtaaactggtaccagcagctcccaggaacggcccccaaactcctcatgtataataatgatcagcggccctcagggtccctgac
cgattctctggctccaagtctggcacctcagcctcccggccatcagtgggctccagtctgaggatgaggctgattattactgtgcagcatggg
atgacagcctcaatggttatgtcttcggacctgggaccaaggtcaccgtcctaggt [SEQ ID NO: 289]

<u>tctagaggtggtggtggtagcggcggcggcggctctggtggtggtggatccctcgagatggcc</u> [SEQ ID NO: 305]

**caggtgcagctggtggagtctggagctgaggtgaagaagcctggggcctcagtgaaggtctcctgcaaggcttctggttacaccttt
accagctatggtatcagctgggtgcgacaggcccctggacaagggcttgagtggatgggatggatcagcgcttacaatggtaacac
aaactatgcacagaagctccagggcagagtcaccatgaccacagacacatccacgagcacagcctacatggagctgaggagcct
gagatctgacgacacggccgtgtattactgtgcgagagacctatctcggggagctaacccgcattactactactactacggtatgga
cgtctggggccaagggaccacggtcaccgtctcctca** [SEQ ID NO: 290]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QAVLTQPPSASGTPGQRVTISCSGSSSNIGSNTVNWYQQLPGTAPKLLMYNNDQRPSGVP
DRFSGSKSGTSASLAISGLQSEDEADYYCAAWDDSLNGYVFGPGTKVTVLG [SEQ ID
NO: 291]

<u>SRGGGGSGGGGSGGGGSLEMA</u> [SEQ ID NO: 307]

**QVQLVESGAEVKKPGASVKVSCKASGYTFTSYGISWVRQAPGQGLEWMGWISAYN
GNTNYAQKLQGRVTMTTDTSTSTAYMELRSLRSDDTAVYYCARDLSRGANPHYYY
YYGMDVWGQGTTVTVSS** [SEQ ID NO: 292]

TSGQAGQHHHHHGAYPYDVPDYAS [SEQ ID NO: 308]

TABLE 74

ET200-125
DNA Sequence
(light chain variable region scFv linker heavy chain variable region His tag + HA tag)
aattttatgctgactcagccccacgctgtgtcggagtctccggggaagacggtaaccatctcctgcacccgcagcagtggcagtattgccagc
aactatgtgcagtggtaccagcagcgcccgggcagttccccccgcactgtgatttatgaggataatcaaagaccctctgggggtccctggtcgg
ttctctggctccatcgacagctcctccaactctgcctccctcaccatctctggactgaagactgaggacgaggctgactactactgtcagtctt
atgattccaccagtgtgcttttcggcggagggaccaagctgaccgtcctaggt [SEQ ID NO: 293]

<u>tctagaggtggtggtggtagcggcggcggcggctctggtggtggtggatccctcgagatggcc</u> [SEQ ID NO: 305]

**gaggtccagctggtgcagtctggggctgaggtgaagaagccagggtcctcggtgaaggtctcctgcaaggcctcgggaggcaccttc
agcagcaattctctcagctgggtgcgacaggcccctggacaagggcttgagtggatgggaaggatcttccctatcctgggtataacaa
actatgcacagaagttccagggcagagtcacgattaccgcggacaaatccacgagcacagcctacatggagctgagcagcctgaga
tctgaggacacggccgtctattactgtgcgagaggaaactaccaatggtatgatgcttttgatatctggggccaagggacaatggtca
ccgtctcttca** [SEQ ID NO: 294]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
NFMLTQPHAVSESPGKTVTISCTRSSGSIASNYVQWYQQRPGSSPRTVIYEDNQRPSGVPG
RFSGSIDSSSNSASLTISGLKTEDEADYYCQSYDSTSVLFGGGTKLTVLG [SEQ ID NO: 295]

<u>SRGGGGSGGGGSGGGGSLEMA</u> [SEQ ID NO: 307]

**EVQLVQSGAEVKKPGSSVKVSCKASGGTFSSNSLSWVRQAPGQGLEWMGRIFPILGI
TNYAQKFQGRVTITADKSTSTAYMELSSLRSEDTAVYYCARGNYQWYDAFDIWGQG
TMVTVSS** [SEQ ID NO: 296]

TSGQAGQHHHHHGAYPYDVPDYAS [SEQ ID NO: 308]

TABLE 75

ET200-005
DNA Sequence
(light chain variable region scFv linker heavy chain variable region His tag + HA tag)
cagcctgtgctgactcagccaccctcagtgtcagtggtcccaggaaagacggccaggattacctgtggggaaaaaacattggaagtaaaa
gtgtgcactggtaccagcagaagccaggccaggcccctgtggtgatccatcattatgatagtgaccggccctcagggatccctgagcgattct
ctggctccaactctgggaacacggccaccctgaccatcagcagggtcgaagccggggatgaggccgactattactgtcaggtgtgggatag
tagtagtgatcatccttatgtcttcggaactgggaccaaggtcaccgtcctaggt [SEQ ID NO: 297]

<u>tctagaggtggtggtggtagcggcggcggcggctctggtggtggtggatccctcgagatggcc</u> [SEQ ID NO: 305]

**caggtgcagctggtgcagtctggagctgaggtgaagaagcctggggcctcagtgaaggtctcctgcaaggcttctggttacacctttta
ccaactatggtatcagctgggtgcgacaggcccctggacaagggcttgagtggatgggatggatcagcgcttacaatggtaacaca
actatgcacataagctccaggggcagagtcaccatgaccacagacacatccacgagcacagccaacatggagctgaggagcctgag
acctgacgacactgccgtgtattactgtgcgcgctcttacttcggttctcatgattactggggtcaaggtactctggtgaccgtctcctca**
[SEQ ID NO: 298]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
QPVLTQPPSVSVVPGKTARITCGGKNIGSKSVHWYQQKPGQAPVVVIHYDSDRPSGIPERF
SGSNSGNTATLTISRVEAGDEADYYCQVWDSSSDHPYVFGTGTKVTVLG [SEQ ID NO: 299]

<u>SRGGGGSGGGGSGGGGSLEMA</u> [SEQ ID NO: 307]

**QVQLVQSGAEVKKPGASVKVSCKASGYTFTNYGISWVRQAPGQGLEWMGWISAYN
GNTNYAHKLQGRVTMTTDTSTSTANMELRSLRPDDTAVYYCARSYFGSHDYWGQG
TLVTVSS** [SEQ ID NO: 300]

TSGQAGQHHHHHGAYPYDVPDYAS [SEQ ID NO: 308]

TABLE 76

ET200-124
DNA Sequence
(light chain variable region scFv linker heavy chain variable region His tag + HA tag)
tcctatgtgctgactcagccaccctcggtgtcagtggccccaggaaagacggccaggattttcctgtgggggaaacgacattggaagtaaaag
tgttttctggtatcagcagaggccaggccaggcccctgtgttggtcgtctatgatgatagcgaccggccctcagggctccctgagcgattctctg
gcttcaactctgggaacacggccaccctgaccatcagcagggtcgaagccggggatgaggccgactattactgtcaagtgtgggatagtagt
agtgatcattatgtcttcggaactgggaccaaggtcaccgtcctaggt [SEQ ID NO: 301]

<u>tctagaggtggtggtggtagcggcggcggcggctctggtggtggtggatccctcgagatggcc</u> [SEQ ID NO: 305]

**caggtgcagctggtggagtctgggggaggcttggtacagcctggcaggtccctgagactctcctgtgcagcctctggattcacctttga
tgattatgccatgcactgggtccggcaagctccagggaagggcctggagtgggtctcaggtattagttggaatagtggtagcataggc
tatgcggactctgtgaagggccgattcaccatctccagagacaacgccaagaactccctgtatctgcaaatgaacagtctgagagctg
aggacacggccttgtattactgtgcaaaagatataaacctatggttcggggagttatggtgcttttgatatctggggccaagggacaatg
gtcaccgtctcttca** [SEQ ID NO: 302]

ACTAGTGGCCAGGCCGGCCAGCACCATCACCATCACCATGGCGCATACCCGTACGAC
GTTCCGGACTACGCTTCT [SEQ ID NO: 306]

Amino Acid Sequence
(light chain variable region scFv linker heavy chain variable region His tag + HA tag)
SYVLTQPPSVSVAPGKTARISCGGNDIGSKSVFWYQQRPGQAPVLVVYDDSDRPSGLPER
FSGFNSGNTATLTISRVEAGDEADYYCQVWDSSSDHYVFGTGTKVTVLG [SEQ ID NO: 303]

<u>SRGGGGSGGGGSGGGGSLEMA</u> [SEQ ID NO: 307]

**QVQLVESGGGLVQPGRSLRLSCAASGFTFDDYAMHWVRQAPGKGLEWVSGISWNS
GSIGYADSVKGRFTISRDNAKNSLYLQMNSLRAEDTALYYCAKDITYGSGSYGAFDI
WGQGTMVTVSS** [SEQ ID NO: 304]

TSGQAGQHHHHHGAYPYDVPDYAS [SEQ ID NO: 308]

Exemplary Anti-FcRL5 Antibodies Comprising a Heavy Chain Variable Region, a Light Chain Variable Region and a Linker Peptide

TABLE 77

ET200-001
DNA Sequence
cagtctgtgttgacgcagccaccctcagcgtctgggaccccgggcagagggtcaccatctcttgttctggaagcagctccaacatcggaagt
aatactgtaaactggtaccagcagctcccaggaacgcccccaaactcctcatctatagtaataatcagcggccctcaggggtccctgaccga
ttctctggctccaagtctggcacctcagcctccctggccatcagtgggctccagtctgaggatgaggctgattattactgtgcagcatgggatga
cagcctgaatggttatgtcttcggaactgggaccaaggtcaccgtcctaggttctagaggtggtggtggtagcggcggcggcggctctggtg
gtggtggatccctcgagatggcccaggtcagctacagcagtggggcgcaggactgttgaagcctttcggagaccctgtccctcacctgcgct
gtgtatggtgggtccttcagtggttactactggagctggatccgccagcccccaggggaagggctggagtggattggggaaatcaatcatagt
ggaagcaccaactacaacccgtccctcaagagtcgagtcaccatatcagtagacacgtccaagaaccagttctccctgaagctgagctctgtg
accgccgcggacacggccgtgtattactgtgcgcgcgaaggtccgtacgacggtttcgattcttgggtcaaggtactctggtgaccgtctcct
caactagtggccaggccggccagcaccatcaccatcaccatggcgcatacccgtacgacgttccggactacgcttct [SEQ ID NO: 593]

Amino Acid Sequence
QSVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKVTVLGSRGGGGSGGG
GSGGGGSLEMAQVQLQQWGAGLLKPSETLSLTCAVYGGSFSGYYWSWIRQPPGKGLEWI
GEINHSGSTNYNPSLKSRVTISVDTSKNQFSLKLSSVTAADTAVYYCAREGPYDGFDSWG
QGTLVTVSSTSGQAGQHHHHHHGAYPYDVPDYAS [SEQ ID NO: 594]

TABLE 78

ET200-002
DNA Sequence
aattttatgctgactcagcccactctgtgtcggagtctccggggaagacggtaaccatctcctgcacccgcagcagtggcagcattgccagc
aactatgtgcagtggtaccagcagcgcccgggcagtgcccccaccactgtgatctatgaggataaccaaagaccctctgggtccctgatcg
gttctctggctccatcgacagctcctccaactctgcctccctccaccatctctggactgaagactgaggacgaggctgactactactgtcagtctt
atgatagcagcaattctgtggtattcggcggagggaccaagctgaccgtcctaggttctagaggtggtggtggtagcggcggcggcggctctg
gtggtggtggatccctcgagatggcccaggtccagctggtacagtctggcactgaggtgaagaagcctggggcctcagtgagggtcgcctg
caaggcttctggttaccccttaacaaatatgacatcaactgggtgcgacaggcccctggacaagggcttgagtggatgggaggcatcatccc
tatctttcgtacaacaaactacgcacagaagttccagggcagagtcacgattaccgcggacgaatccacgagcacagcctacatggagctga
gcagcctgagatctgaggacacggccgtatattactgtgcgcgcgaatggttctactggatatctggggtcaaggtactctggtgaccgtctc
ctcaactagtggccaggccggccagcaccatcaccatcaccatggcgcatacccgtacgacgttccggactacgcttct [SEQ ID NO: 595]

Amino Acid Sequence
NFMLTQPHSVSESPGKTVTISCTRSSGSIASNYVQWYQQRPGSAPTTVIYEDNQRPSGVPD
RFSGSIDSSSNSASLTISGLKTEDEADYYCQSYDSSNSVVFGGGTKLTVLGSRGGGGSGGG
GSGGGGSLEMAQVQLVQSGTEVKKPGASVRVACKASGYPFNKYDINWVRQAPGQGLEW
MGGIIPIFRTTNYAQKFQGRVTITADESTSTAYMELSSLRSEDTAVYYCAREWFYWDIWG
QGTLVTVSSTSGQAGQHHHHHHGAYPYDVPDYAS [SEQ ID NO: 596]

TABLE 79

ET200-003
DNA Sequence
cagtctgtgttgactcagccaccctcagtgtccgtgtccccaggacagacagccagcatctcctgctctggaaataaattggggactaagtatgt
ttactggtatcagaagaggccaggccagtcccctgtgttggtcatgtatgaagataatcagcggccctcagggatcccggagcggttctctgg
ctccaactctgggaacacagccactctgaccatcagagggacccagactgtggatgaggctgactattactgtcaggcgtgggactccgaca
ctttcgtggtcttcggcggagggaccaaggtcaccgtcctaggttctagaggtggtggtggtagcggcggcggcggctctggtggtggtgga
tccctcgagatggccgaggtgcagctggtggagaccgggggaggcgtggtccagcctgggaggtccctgagactctcctgtgcagcctctg
gattcaccttcagtagttatggcatgcactgggtccgccaggctccaggcaaggggctggagtgggtggcagttatatcacatgatggaagta
ataaatactacgcagactccgtgaagggccgattcaccatctccagagacaattccaaggacacgctgtatctgcaaatgaacagcctgagaggt
gaggacacggccgtatattactgtgcgcgctctaaccagtggtctggttacttctctttcgattactgggtcaaggtactctggtgaccgtctc
ctcaactagtggccaggccggccagcaccatcaccatcaccatggcgcatacccgtacgacgttccggactacgcttct [SEQ ID NO: 597]

Amino Acid Sequence
QSVLTQPPSVSVSPGQTASISCSGNKLGTKYVYWYQKRPGQSPVLVMYEDNQRPSGIPER
FSGSNSGNTATLTIRGTQTVDEADYYCQAWDSDTFVVFGGGTKVTVLGSRGGGGSGGG
SGGGGSLEMAEVQLVETGGGVVQPGRSLRLSCAASGFTFSSYGMHWVRQAPGKGLEWV
AVISHDGSNKYYADSVKGRFTISRDNSKDTLYLQMNSLRGEDTAVYYCARSNQWSGYFS
FDYWGQGTLVTVSSTSGQAGQHHHHHHGAYPYDVPDYAS [SEQ ID NO: 598]

TABLE 80

ET200-006
DNA Sequence
tcctatgtgctgactcagccaccctcagtgtcagtggccccaggaaagacggccaggattacctgtgggggaaacaacattggaagtaaaagt
gtgcactggtaccagcagaagccaggccaggcccctgtggtggtcatccattatgatagcgaccggccctcagggatccctgagcgattctct
ggctccaactctgggaacacggccaccctgaccatcagcagggtcgaagccggggatgaggccgactattactgtcaggtgtgggatagtag
tagtgatcatccttatgtcttcggaactgggaccaaggtcaccgtcctaggttctagaggtggtggtggtagcggcggcggcggctctggtggtg
gtggatccctcgagatggccgaggtgcagctggtgcagtctggagctgaggtgaagaagcctggggcctcagtgaaggtctcctgcaaggct
tctggttacacctttaccacctatggtatcagctgggtgcgacaggcccctggacaagggcttgagtggatgggatggatcaacacttacaatgg
tcacacaaactatgcacagaagctccagggcagagccacaatgaccgcagaacatccacgaacacagcctacatggagctgaggagcctg
agatctgacgacactgccgtgtattactgtgcgcgcgttatctacggttctggtgattactgggtcaaggtactctggtgaccgtctcctcaac
tagtggccaggccggccagcaccatcaccatcaccatggcgcataccctacgacgttccggactacgcttct [SEQ ID NO: 599]

Amino Acid Sequence
SYVLTQPPSVSVAPGKTARITCGGNNIGSKSVHWYQQKPGQAPVVVIHYDSDRPSGIPERFS
GSNSGNTATLTISRVEAGDEADYYCQVWDSSSDHPYVFGTGTKVTVLGSRGGGGSGGGG
SGGGGSLEMAEVQLVQSGAEVKKPGASVKVSCKASGYTFTTYGISWVRQAPGQGLEWM
GWINTYNGHTNYAQKLQGRATMTADTSTNTAYMELRSLRSDDTAVYYCARVIYGSGDY
WGQGTLVTVSSTSGQAGQHHHHHHGAYPYDVPDYAS [SEQ ID NO: 600]

TABLE 81

ET200-007
DNA Sequence
tcctatgtgctgactcagccactctcagtgtcagtggccccaggaaagacggccaggattacctgtgggggaaacaacattggaagtaaaact
gtgcactggtaccagcagaagccaggccaggcccctgtgctggtcatctattatgatagcgaccggccctcagggatccctgagcgattctct
ggctccaactctgggaacacggccaccctgaccatcagcagggtcgaagccggggatgaggccgactattactgtcaggtgtgggatagta
gtagtgatcatcgggtgttcggcggagggaccaagctgaccgtcctaggttctagaggtggtggtggtagcggcggcggcggctctggtggt
ggtggatccctcgagatggccaggtgcagctgcaggagtcgggcccaggactggtgaagccttcggagaccctgtcctcacctgcaatg
tctctggttactccatcagcagtggttactttggggctggatccggcagccccagggaaggggctggagtggattgggagtatctatcatagt
aggagcacctactacaacccgtccctcaagagtcgagtcaccatatcagtagacacgtccaagaaccagttctccctgaagctgaactctgtg
accgccgcagacacggccgtgtattactgtgcgcgcggttacggttacttcgattactgggtcaaggtactctggtgaccgtctcctcaacta
gtggccaggccggccagcaccatcaccatcaccatggcgcataccctacgacgttccggactacgcttct [SEQ ID NO: 601]

Amino Acid Sequence
SYVLTQPLSVSVAPGKTARITCGGNNIGSKTVHWYQQKPGQAPVLVIYYDSDRPSGIPERF
SGSNSGNTATLTISRVEAGDEADYYCQVWDSSSDHRVFGGGTKLTVLGSRGGGGSGGGG
SGGGGSLEMAQVQLQESGPGLVKPSETLSLTCNVSGYSISSGYFWGWIRQPPGKGLEWIG
SIYHSRSTYYNPSLKSRVTISVDTSKNQFSLKLNSVTAADTAVYYCARGYGYFDYWGQGT
LVTVSSTSGQAGQHHHHHHGAYPYDVPDYAS [SEQ ID NO: 602]

TABLE 82

ET200-008
DNA Sequence
caatctgccctgactcagcctgcctccgtgtctgggtctcctggacagtcgatcaccatctcctgcactggaaccagcagtgacgttggtggtta
taactatgtctcctggtaccaacaacacccaggcaaagcccccaaactcatgatttatgatgtcagtaatcggccctcaggggtttctaatcgct
tctctggctccaagtctggcaacacggcctccctgaccatctctgggctccaggctgaggacgaggctgattattactgcagctcatatacaag
cagcagcacttcgaaggtgttcggcggagggaccaagctgaccgtcctaggttctagaggtggtggtggtagcggcggcggcggctctggtgg
tggtggatccctcgagatggccgaggtgcagctggtggagtctgggggaggtgtggtacggcctgggggtcctgagactctcctgtgcagc
ctctggattcacctttggtgattatgcatgagctgggtccgccaagctccagggaaggggctggagtgggtctctggtattaattggaatggt
ggtagcacaggttatgcagactctgtgaagggccgattcaccatctccagagacaacgccaagaactccctgtatctgcaaatgaacagtctg
agagccgaggacacggccgtatattactgtgcgcgctctaaatacaacttccatgtttactacgattactgggtcaaggtactctggtgaccgt
ctcctcaactagtggccaggccggccagcaccatcaccatcaccatggcgcataccctacgacgttccggactacgcttct [SEQ ID NO: 603]

Amino Acid Sequence
QSALTQPASVSGSPGQSITISCTGTSSDVGGYNYVSWYQQHPGKAPKLMIYDVSNRPSGVS
NRFSGSKSGNTASLTISGLQAEDEADYYCSSYTSSSTSKVFGGGTKLTVLGSRGGGGSGGG
GSGGGGSLEMAEVQLVESGGGVVRPGGSLRLSCAASGFTFGDYGMSWVRQAPGKGLEW
VSGINWNGGSTGYADSVKGRFTISRDNAKNSLYLQMNSLRAEDTAVYYCARSKYNFHVY
YDYWGQGTLVTVSSTSGQAGQHHHHHHGAYPYDVPDYAS [SEQ ID NO: 604]

TABLE 83

ET200-009
DNA Sequence
cagtctgtgttgacgcagccaccctcagcgtctgggaccccgggcagacagtcaccatctcttgttctggaagcaactccaacatcggaagta
attatgtatactggtaccagcagctcccaggaacggcccccaaactcctcatctataggaataatcagcggccctcaggggtccctgaccgattc
tcaggctccaagtctggcacctcagcctccctggccatcagtgggctccgctccgaggatgaggctgattattactgtgcagcatgggatgaca
gcctgagtgcttatgtcttcggaactgggaccaaggtcaccgtcctaggttctagaggtggtggtggtagcggcggcggcggctctggtggtg
gtggatccctcgagatggcccaggtgcagctggtgcagtctggagctgaggtgaagaagcctggggcctcagtgaaggtctcctgcaaggct
tctgttacacctttaccagctatggtatcagctgggtgcgacaggcccctggacaagggcttgagtggatgggatggatcagcgcttacaatg
gtaacacaaactatgcacagaagctccagggcagagtcaccatgaccacagacacatccacgagcacagcctacatggagctgaggagcct
gagatctgacgacactgccgtgtattactgtgcgcgcttcttctggtaacatggtttcttggaaagatatgtggggtcaaggtactctggtgaccg
tctcctcaactagtggccaggccggccagcaccatcaccatcaccatggcgcatacccgtacgacgttccggactacgcttct [SEQ ID
NO: 605]

Amino Acid Sequence
QSVLTQPPSASGTPGQTVTISCSGSNSNIGSNYVYWYQQLPGTAPKLLIYRNNQRPSGVPDR
FSGSKSGTSASLAISGLRSEDEADYYCAAWDDSLSAYVFGTGTKVTVLGSRGGGGSGGGG
SGGGGSLEMAQVQLVQSGAEVKKPGASVKVSCKASGYTFTSYGISWVRQAPGQGLEWM
GWISAYNGNTNYAQKLQGRVTMTTDTSTSTAYMELRSLRSDDTAVYYCARSSGNMVSW
KDMWGQGTLVTVSSTSGQAGQHHHHHHGAYPYDVPDYAS [SEQ ID NO: 606]

TABLE 84

ET200-010
DNA Sequence
caatctgccctgactcagcctgcctccgtgtctgggtctcctggacagtcgatcaccatctcctgcactggaaccagcagtgacgttggtggtta
taactctgtctcctggtaccaacaacaccaggcaaagccccccagactcagattatgatgtcagtaatcggccctcagggggtttctaatcgct
tctctggctccaagtctggcaacacggcctccctgaccatctctgggctccaggctgaggacgaggctgattattactgcagctcatatacaag
cagcagcacccctttagtcttcggaactgggaccaaggtcaccgtcctaggttctagaggtggtggtggtagcggcggcggcggctctggtggt
ggtggatccctcgagatggcccaggtgcagctggtgcagtctggggctgaggtgaagaagcctggggcctcagtgaaggtctcctgcaaggc
ttctgttacacctttaccagctatggtatcagctgggtgcgacaggcccctggacaagggcttgagtggatgggatggatcagcgcttacaat
ggtaacacaaactatgcacagaagctccagggcagagtcaccatgaccacagacacatccacgagcacagcctacatggagctgaggagcctg
agatctgacgacacggccgtgtattactgtgcgcgcggtgctgttgcttaccatgattgggtcaaggtactctggtgaccgtctcctcaacta
gtggccaggccggccagcaccatcaccatcaccatggcgcatacccgtacgacgttccggactacgcttct [SEQ ID NO: 607]

Amino Acid Sequence
QSALTQPASVSGSPGQSITISCTGTSSDVGGYNSVSWYQQHPGKAPRLMIYDVSNRPSGVS
NRFSGSKSGNTASLTISGLQAEDEADYYCSSYTSSSTPLVFGTGTKVTVLGSRGGGGSGGG
GSGGGGSLEMAQVQLVQSGAEVKKPGASVKVSCKASGYTFTSYGISWVRQAPGQGLEW
MGWISAYNGNTNYAQKLQGRVTMTTDTSTSTAYMELRSLRSDDTAVYYCARGAVAYHD
WGQGTLVTVSSTSGQAGQHHHHHHGAYPYDVPDYAS [SEQ ID NO: 608]

TABLE 85

ET200-011
DNA Sequence
cagtctgtcgtgacgcagccgccctcagtgtctgcggccccaggacagagggtcaccatctcctgctctggaagcagctccaacatttcgattt
atgatgtatcctggtatcagcagctcccaggaacagcccccaaactcctcatttatggcaataataagcgaccctcggggattgctgaccgattc
tctggctccacgtctgcacgtcagccaccctgggcatcaccggactccagactggggacgaggccgattattactgcgaacatgggatga
cagtctgagtggggggtgttcggcggagggaccaagctgaccgtcctaggttctagaggtggtggtggtagcggcggcggcggctctggt
ggtggtggatccctcgagatggcccagatgcagctggtgcaatctggggctgaggtgaagaagcctgggtcctcggtgaaggtctcctgcg
aggcttctggaggcacccctcagcagctatgctatcaactgggtgcgacaggcccctggacaagggcttgagtggatgggagggatcatccct
atgtttggtacagcacactacgcacagaagttccagggcagagtcacgattaccgcggacgaatccacgaaaacagcctacatggagctga
gcagcctgagatctgaggacactgccgtgtattactgtgcgcgcggtgttcattacgcttcttcgatcattgggtcaaggtactctggtgacc
gtctcctcaactagtggccaggccggccagcaccatcaccatcaccatggcgcatacccgtacgacgttccggactacgcttct [SEQ ID
NO: 609]

Amino Acid Sequence
QSVVTQPPSVSAAPGQRVTISCSGSSSNISIYDVSWYQQLPGTAPKLLIYGNNKRPSGIADR
FSGSTSGTSATLGITGLQTGDEADYYCGTWDDSLSGGVFGGGTKLTVLGSRGGGGSGGG
GSGGGGSLEMAQMQLVQSGAEVKKPGSSVKVSCEASGGTLSSYAINWVRQAPGQGLEW
MGGIIPMFGTAHYAQKFQGRVTITADESTKTAYMELSSLRSEDTAVYYCARGVHYASFD
HWGQGTLVTVSSTSGQAGQHHHHHHGAYPYDVPDYAS [SEQ ID NO: 610]

TABLE 86

ET200-012
DNA Sequence
cagtctgtgttgacgcagccgccctcagtgtctgcggccgcaggacagaaggtcaccatctcctgctctggaagcgactccaacattgggaat
aattatgtgtcctggtatcaacacctcccagggacagcccccaaactcctcatttatgacgttaaaaatcgaccctcagggattcctgaccggtt
ctccggctccaagtctggctcgtcagccaacctaggcatcgccggactccagcctggggacgaggccgattattactgcggaacatgggaca
gtcggctggatgcctatgtcttcggaactgggaccaaggtcaccgtcctaggttctagaggtggtggtggtagcggcggcggcggctctggt
ggtggtggatcccctcgagatggcccagatgcagctggtgcaatctggagctgaggtgaagaagcctggggcctcagtgaaggtctcctgca
agacttctggtttccccttaatatctttggaatcacctgggtgcgacaggcccctggacaagggcttgagtggatgggatggatcagcggttac
aacggtaacacagactacccacagaagttccagggcagagtcaccatgtccacagacacatccacgagtacagcctacatggagctgagga
acctgaaatctgacgacacggccgtgtattactgtgcgcgcggtgcttacggtggtatggatacttggggtcaaggtactctggtgaccgtctc
ctcaactagtggccaggccggccagcaccatcaccatcaccatggcgcatacccgtacgacgttccggactacgcttct [SEQ ID NO: 611]

Amino Acid Sequence
QSVLTQPPSVSAAAGQKVTISCSGSDSNIGNNYVSWYQHLPGTAPKLLIYDVKNRPSGIPD
RFSGSKSGSSATLGIAGLQPGDEADYYCGTWDSRLDAYVFGTGTKVTVLGSRGGGGSGG
GGSGGGGSLEMAQMQLVQSGAEVKKPGASVKVSCKTSGFPFNIFGITWVRQAPGQGLEW
MGWISGYNGNTDYPQKFQGRVTMSTDTSTSTAYMELRNLKSDDTAVYYCARGAYGGM
DTWGQGTLVTVSSTSGQAGQHHHHHHGAYPYDVPDYAS [SEQ ID NO: 612]

TABLE 87

ET200-013
DNA Sequence
cagtctgtcgtgacgcagccgccctcagtgtctggggcccagggcagagggtcaccatctcctgcactgggagcacctccaacatcgggg
caggttatgatgtacactggtatcagcagcttccaggaacagcccccaaactcctcatctatactaacaactttcggccctcaggggtccctgac
cgattctctgcctccaagtctggcacttcagcttccctggccatcactggtctccaggctgaggatgaggctgattattactgcggaacatggga
tagcagcctgagtgccgttgtgttcggcggagggaccaagctgaccgtcctaggttctagaggtggtggtggtagcggcggcggcggctct
ggtggtggtggatcccctcgagatggccgaggtgcagctggtggagtctggaactgaggtgaagaagcctggggcctcagtgaaagtctcct
gcaaggcttctggttacatgtttaccagttatggtctcaactgggtgcgacaggcccctggacaagggcttgagtggatggatgatcagcg
ctaacaatggtaagacaaattatgctaagaaattccaggacagagtcaccatgaccagagacacttccacgagcacaggctacatggaactg
aggagcctgagatctgacgacacggccgtatattactgtgcgcgccatatcggtggttcttacttcgatcgttgggtcaaggtactctggtgac
cgtctcctcaactagtggccaggccggccagcaccatcaccatcaccatggcgcatacccgtacgacgttccggactacgcttct [SEQ
ID NO: 613]

Amino Acid Sequence
QSVVTQPPSVSGAPGQRVTISCTGSTSNIGAGYDVHWYQQLPGTAPKLLIYTNNFRPSGVP
DRFSASKSGTSASLAITGLQAEDEADYYCGTWDSSLSAVVFGGGTKLTVLGSRGGGGSGG
GGSGGGGSLEMAEVQLVESGTEVKKPGASVKVSCKASGYMFTSYGLNWVRQAPGQGLE
WMGWISANNGKTNYAKKFQDRVTMTRDTSTSTGYMELRSLRDDTAVYYCARHIGGSY
FDRWGQGTLVTVSSTSGQAGQHHHHHHGAYPYDVPDYAS [SEQ ID NO: 614]

TABLE 88

ET200-014
DNA Sequence
tcctatgtgctgactcagccaccctcagtgtcagtggccccaggaaagacggccaggattacctgtgggggaaacaacattggaagtaaaagt
gtgcactggtaccagcagaagccaggccaggcccctgtgctggtcatctattatgatagcgaccggccctcagggatccctgagcgattctctg
gctccaactctgggaacacggccaccctgaccatcagcagggtcgaagccggggatgaggccgactattactgtcaggtgtgggatagtagt
agtgatcattatgtcttcggaactgggaccaaggtcaccgtcctaggttctagaggtggtggtggtagcggcggcggcggctctggtggtggtg
gatcccctcgagatggccgaggtgcagctggtggagactggggaggcttggtacagcctggggggtccctgagactctcctgtgcagcctct
ggattcacctttagcagctatgccatgagctgggtccgccaggctccagggaaggggctggagtgggtctcagctattagtggtagtgatggta
gcacatactacgcagactccgtgaagggccggttcaccatctccagagacaattccaagaacacgctgtatctgcaaatgaacagcctgagag
acgaggacacggccgtatattactgtgcgcgctctcatgaagctaacctggttggtgattggtgggtcaaggtactctggtgaccgtctcctca
actagtggccaggccggccagcaccatcaccatcaccatggcgcatacccgtacgacgttccggactacgcttct [SEQ ID NO: 615]

Amino Acid Sequence
SYVLTQPPSVSVAPGKTARITCGGNNIGSKSVHWYQQKPGQAPVLVIYYDSDRPSGIPERFS
GSNSGNTATLTISRVEAGDEADYYCQVWDSSSDHYVFGTGTKVTVLGSRGGGGSGGGGS
GGGGSLEMAEVQLVETGGGLVQPGGSLRLSCAASGFTFSSYAMSWVRQAPGKGLEWVSA
ISGSDGSTYYADSVKGRFTISRDNSKNTLYLQMNSLRDEDTAVYYCARSHEANLVGDWW
GQGTLVTVSSTSGQAGQHHHHHHGAYPYDVPDYAS [SEQ ID NO: 616]

TABLE 89

ET200-015
DNA Sequence
cagtctgtggtgactcagccaccctcagtgtcagtggccccaggaaagacggccaggattacctgtggggggaaacaacattggaagtaaaa
gtgtgcactggtaccagcagaagccaggccaggcccctgtgctggtcatctattatgatagcgaccggccctcagggatccctgagcgattct
ctggctccaactctgggaacacggccaccctgaccatcagcagggtcgaagccggggatgaggccgactattactgtcaggtgtgggatag
tagtagtgatggtattcggcggagggaccaagctgaccgtcctaggttctagaggtggtggtggtagcggcggcggcggctctggtggtg
gtggatccctcgagatggccgaggtccagctggtacagtctggagctgaggtgaagaagcctggggcctcagtgaaggtctcctgcaaggc
ttctggttacacctttaccagctacggtatcagctgggtgcgacaggcccctggacaagggcttgagtggatgggatggatcagcgcttacaat
ggtaacacaaactatgcacagaagctccagggcagagtcaccatgaccacagacacatccacgagcacagcctacatggagctgaggagc
ctgagatctgacgacacggccgtgtattactgtgcgcgctgggggttggttccggtgctgttgatcattgggggtcaaggtactctggtgaccgtctc
ctcaactagtggccaggccggccagcaccatcaccatcaccatggcgcatacccgtacgacgttccggactacgcttct [SEQ ID NO: 617]

Amino Acid Sequence
QSVVTQPPSVSVAPGKTARITCGGNNIGSKSVHWYQQKPGQAPVLVIYYDSDRPSGIPERF
SGSNSGNTATLTISRVEAGDEADYYCQVWDSSSDVVFGGGTKLTVLGSRGGGSGGGGS
GGGGSLEMAEVQLVQSGAEVKKPGASVKVSCKASGYTFTSYGISWVRQAPGQGLEWMG
WISAYNGNTNYAQKLQGRVTMTTDTSTSTAYMELRSLRSDDTAVYYCARWGGFGAVDH
WGQGTLVTVSSTSGQAGQHHHHHHGAYPYDVPDYAS [SEQ ID NO: 618]

TABLE 90

ET200-016
DNA Sequence
tcttctgagctgactcaggaccctgctgtgtctgtggccttgggacagacagtcaagatcacgtgccaaggagacagcctcacagactaccat
gcaacctggtaccagcagaagccaggacaggcccctgtcgctgtcatctatgctacaaacaaccggcccactgggatcccagaccgattctc
tggttccagttccggaaacacagcttctttgaccatcactggggctcaggcggaagatgaggctgactattactgtaatcccggacagcggc
acggacgaagtgttattcggcggagggaccaagctgaccgtcctaggttctagaggtggtggtggtagcggcggcggcggctctggtggtg
gtggatccctcgagatggccgaggtgcagctggtggagactggggggaggcctggtcaagcctggggggtccctgagactctcctgtgcag
cctctggattcaccttcagtagctatagcatgaactgggtccgccaggctccagggaaggggctggagtgggtctcatccattagtagtagtag
tagttacatatactacgcagactcagtgaagggccgattcaccatctccagagacaacgccaagaactcactgtatctgcaaatgaacagcctg
agagccgaggacacggccgtgtattactgtgcgcgcggtcagggttacgattactggggtcaaggtactctggtgaccgtctcctcaactagt
ggccaggccggccagcaccatcaccatcaccatggcgcatacccgtacgacgttccggactacgcttct [SEQ ID NO: 619]

Amino Acid Sequence
SSELTQDPAVSVALGQTVKITCQGDSLTDYHATWYQQKPGQAPVAVIYATNNRPTGIPDR
FSGSSSGNTASLTITGAQAEDEADYYCNSRDSGTDEVLFGGGTKLTVLGSRGGGSGGGG
SGGGGSLEMAEVQLVETGGGLVKPGGSLRLSCAASGFTFSSYSMNWVRQAPGKGLEWV
SSISSSSYIYYADSVKGRFTISRDNAKNSLYLQMNSLRAEDTAVYYCARGQGYDYWGQG
TLVTVSSTSGQAGQHHHHHHGAYPYDVPDYAS [SEQ ID NO: 620]

TABLE 91

ET200-017
DNA Sequence
tcctatgtgctgactcagccaccctcggtgtcagtggccccaggaaagacggccaggattacctgtggggggaaacaacattggaagtaaaag
tgtgcactggtaccagcagaagccaggccaggcccctgtgctggtcgtctatgatgatagcgaccggccctcagggatccctgagcgattct
ctggctccaactctgggaacacgccaccctgagcatcagcagggtcgaagccggggatgaggccgactattactgtcaggtgtgggatag
tagtagtgatcatactgtcttcggaactgggaccaaggtcaccgtcctaggttctagaggtggtggtggtagcggcggcggcggctctggtgg
tggtggatccctcgagatggccgaggtgcagctacagcagtggggcgcaggactgttgaagccttcggagaccctgtcctcacctgcgctg
tctatggtgggtccttcagtggttactactggagctggatccgccagcccccagggaaggggctggagtggattgggaaatcaatcatagtg
gaagcaccaactacaacccgtccctcaagagtcgagtcaccatatcagtagacacgtccaagaaccagttctccctgaagctgagctctgtga
ccgccgcggacacggccgtgtattactgtgcgcgctactacccgggtatggatatgtggggtcaaggtactctggtgaccgtctcctcaacta
gtggccaggccggccagcaccatcaccatcaccatggcgcatacccgtacgacgttccggactacgcttct [SEQ ID NO: 621]

Amino Acid Sequence
SYVLTQPPSVSVAPGKTARITCGGNNIGSKSVHWYQQKPGQAPVLVVYDDSDRPSGIPER
FSGSNSGNTATLSISRVEAGDEADYYCQVWDSSSDHTVFGTGTKVTVLGSRGGGSGGG
GSGGGGSLEMAQVQLQQWGAGLLKPSETLSLTCAVGGSFSGYYWSWIRQPPGKGLEWI
GEINHSGSTYNPSLKSRVTISVDTSKNQFSLKLSSVTAADTAVYYCARYYPGMDMWGQ
GTLVTVSSTSGQAGQHHHHHHGAYPYDVPDYAS [SEQ ID NO: 622]

TABLE 92

ET200-018
DNA Sequence
caggctgtgctgactcagccgccctcaacgtctgggaccccgggcagagggtcaccatctcttgttctggaagcagctccaacatcgggag
aaatggtgtaaactggtaccagcagctcccaggagcggcccccaaagtcctcatctataatgataatcagcgaccctcagggtccctgacc
gagtctctggctcccagtctggctcctcaggcaccctggccatcgatgggcttcggtctgaggatgaggctgattattactgtgcggcatggga
tgacagcctgcatggtgtggtattcggcggagggaccaagctgaccgtcctaggttctagaggtggtggtggtagcggcggcggcggctct
ggtggtggtggatccctcgagatggcccaggtccagctggtacagtctggggctgaggtgaagaagcctggggcctcagtgaaggtctcct
gcaaggtttccggatacacccctcaatgaattatccatgcactgggtgcgacaggctcctggaaaagggcttgagtggatgggaggttttgatcc
tgaagatggtgaaacaatctacgcacagaagttccagggcagagtcaccatgaccgaggacacatctacagacacagcctacatggagctg
agcagcctgagatctgaggacactgccgtgtattactgtgcgcgcggtggttacggtgattcttggggtcaaggtactctggtgaccgtctcctc
aactagtggccaggccggccagcaccatcaccatcaccatggcgcatacccgtacgacgttccggactacgcttct [SEQ ID NO:
623]

Amino Acid Sequence
QAVLTQPPSTSGTPGQRVTISCSGSSSNIGRNGVNWYQQLPGAAPKVLIYNDNQRPSGVPD
RVSGSQSGSSGTLAIDGLRSEDEADYYCAAWDDSLHGVVFGGGTKLTVLGSRGGGGSGG
GGSGGGGSLEMAQVQLVQSGAEVKKPGASVKVSCKVSGYTLNELSMHWVRQAPGKGL
EWMGGFDPEDGETIYAQKFQGRVTMTEDTSTDTAYMELSSLRSEDTAVYYCARGGYGD
SWGQGTLVTVSSTSGQAGQHHHHHHGAYPYDVPDYAS [SEQ ID NO: 624]

TABLE 93

ET200-019
DNA Sequence
aattttatgctgactcagccccactctgtgtcggagtctccggggaagacggtaaccatctcctgcacccgcagcagtggcagcattgccagca
actatgtgcagtggtaccagcagcgcccgggcagtgcccccaccactgtgatctatgaggataaccaaagaccctctggggtccctgatcggtt
ctctggctccatcgacagctcctccaactctgcctccctccaccatctctggactagaactgaggacgaggctgactactactgtcagtcttatg
atagcagcaattcttgggtgttcggcggagggaccaagctgaccgtcctaggttctagaggtggtggtggtagcggcggcggcggctctggtggt
ggtggatccctcgagatggcccaggtgcagctggtgcaatctggggctgaggtgaagaggcctgggtcctcggtgaaggtctcctgcacggc
ttctggaggcacctttcagcagcgatgctatcagctgggtgcgacaggcccctggacaagggcttgagtggatgggaggaatcatccctatgttt
ggtacagcaaactacgcacagaagttccagggcagagtcacgattaccgcggacgaatccacgagcacagcctacatggagctgagcagcc
tgagatctgaggacacggccgtgtattactgtgcgcgcgaaggttactactacccgtctgcttacctgggttctgttctgaacgacatctcttct
gtttacgatgaatggggtcaaggtactctggtgaccgtctcctcaactagtggccaggccggccagcaccatcaccatcaccatggcgcatacc
cgtacgacgttccggactacgcttct [SEQ ID NO: 625]

Amino Acid Sequence
NFMLTQPHSVSESPGKTVTISCTRSSGSIASNYVQWYQRPGSAPTTVIYEDNQRPSGVPDR
FSGSIDSSSNSASLTISGLKTEDEADYYCQSYDSSNSWVFGGGTKLTVLGSRGGGGSGGG
SGGGGSLEMAQVQLVQSGAEVKRPGSSVKVSCTASGGTFSSDAISWVRQAPGQGLEWMG
GIIPMFGTANYAQKFQGRVTITADESTSTAYMELSSLRSEDTAVYYCAREGYYYPSAYLGS
VLNDISSVYDEWGQGTLVTVSSTSGQAGQHHHHHHGAYPYDVPDYAS [SEQ ID NO: 626]

TABLE 94

ET200-020
DNA Sequence
cagtctgtcgtgacgcagccgccctcagtgtctgcggccccaggacagaaggtcaccatctcctgctctggaagcacctccaacattggaaata
atgatgtatcctggtaccagcagctcccaggaacagcccccaaactcctcatttatgacaataataagcgaccctcagggattcctgaccgattc
tctggctccaagtctggcacgtcagccaccctgggcatcaccggactccagactggggacgaggccgattattactgcgggaacatgggatagc
agcgtgagtgcttcttgggtcttcggcagagggaccaagctgaccgtcctaggttctagaggtggtggtggtagcggcggcggcggctctggt
ggtggtggatccctcgagatggcccaggtgcagctggtgcagtctggagctgaggtgaagaagcctggggcctcagtgaaggtctcctgcaa
ggcttctggttacacctttaccagctatggtatcagctgggtgcgacaggcccctggacaagggcttgagtggatgggatggatcagcgttac
aatggtaacacaaactatccacagaagctccagggcagagtcaccatgaccacagacccatccacgagcacagcctacatggagctgagga
gcctgagatctgacgacacggccgtgtattactgtgcgcgctctatgacttctttcgattactggggtcaaggtactctggtgaccgtctcctca
actagtggccaggccggccagcaccatcaccatcaccatggcgcatacccgtacgacgttccggactacgcttct [SEQ ID NO: 627]

Amino Acid Sequence
QSVVTQPPSVSAAPGQKVTISCSGSTSNIGNNDVSWYQQLPGTAPKLLIYDNNKRPSGIPDR
FSGSKSGTSATLGITGLQTGDEADYYCGTWDSSVSASWVFGRGTKLTVLGSRGGGGSGGG
GSGGGGSLEMAQVQLVQSGAEVKKPGASVKVSCKASGYTFTSYGISWVRQAPGQGLEW
MGWISAYNGNTNYPQKLQGRVTMTTDPSTSTAYMELRSLRSDDTAVYYCARSMTSFDY
WGQGTLVTVSSTSGQAGQHHHHHHGAYPYDVPDYAS [SEQ ID NO: 628]

TABLE 95

ET200-021
DNA Sequence
cagtctgtgttgacgcagccgccctcagtgtctgcggccccaggacagaaggtcaccatctcctgctctggaagcaactccaacattgggaata
attatgtatcctggtatcagcaactcccagggacagcccccaaactcctcatttatgacaataataagcgaccctcagggattcctgaccgattc
tctggctccaggtctggcacgtcagccaccctgggcatcaccggactccagactggggacgaggccgattattactgcggaacatggaatacca
ctgtgactcctggctatgtcttcggaactgggaccaaggtcaccgtcctaggttctagaggtggtggtggtagcggcggcggcggctctggtgg
tggtggatccctcgagatggccgaagtgcagctggtgcagtctggagctgaggtgaagaagcctggggcctcagtgaaggtctcctgcaagg
cttctggttacaccttaccagctatggtatcagctgggtgcgacaggcccctggacaagggcttgagtggatgggatggatcagcgcttacaat
ggtaacacaaactatgcacagaagctccagggcagagtcaccatgaccacagacacatccacgagcacagcctacatggagctgaggagcc
tgagatctgacgacaccgccatgtattactgtgcgcgctctgtttacgacctggatacttgggtcaaggtactctggtgaccgtctcctcaac
tagtggccaggccggccagcaccatcaccatcaccatggcgcatacccgtacgacgttccggactacgcttct [SEQ ID NO: 629]

Amino Acid Sequence
QSVLTQPPSVSAAPGQKVTISCSGSNSNIGNNYVSWYQQLPGTAPKLLIYDNNKRPSGIPDR
FSGSRSGTSATLGITGLQTGDEADYYCGTWNTTVTPGYVFGTGTKVTVLGSRGGGGSGGG
GSGGGGSLEMAEVQLVQSGAEVKKPGASVKVSCKASGYTFTSYGISWVRQAPGQGLEW
MGWISAYNGNTNYAQKLQGRVTMTTDTSTSTAYMELRSLRSDDTAMYYCARSVYDLDT
WGQGTLVTVSSTSGQAGQHHHHHHGAYPYDVPDYAS [SEQ ID NO: 630]

TABLE 96

ET200-022
DNA Sequence
cagtctgtcgtgacgcagccgccctcagtgtctgcggccccaggacagaaggtcaccatctcctgctctggaagcagctccaacattgggaat
aattatgtatcctggtaccagcagctcccaggaacagcccccaaactcctcatttatgacaataataagcgaccctcagggattcctgaccgatt
ctctggctccaagtctggcacgtcagccaccctgggcatcaccggactccagactggggacgaggccgattattactgcgganacatgggatagc
agcctgggggccccttatgtcttcggaactgggaccaaggtcaccgtcctaggttctagaggtggtggtggtagcggcggcggcggctctggt
ggtggtggatccctcgagatggccgaggtgcagctggtgcagtcttggggaggctcggaacagcctggcaggtccctgagactctcctgtgc
agcctctggattcacctttgatgattatgccatgcactgggtccggcaagctccaggaaagggcctggagtgggtctcaggtattagttggaata
gcggtagcataggctatgcggactctgtgaaggcgccgattcaccatctccagagacaacgccaagaattccctgtatctgcaaatgaacagtct
gagagctgaggacaccgccatgtattactgtgcgcgctaccgtcaggttggtctgcttacgattcttggggtcaaggtactctggtgaccgtc
tcctcaactagtggccaggccggccagcaccatcaccatcaccatggcgcatacccgtacgacgttccggactacgcttct [SEQ ID NO: 631]

Amino Acid Sequence
QSVVTQPPSVSAAPGQKVTISCSGSSSNIGNNYVSWYQQLPGTAPKLLIYDNNKRPSGIPDR
FSGSKSGTSATLGITGLQTGDEADYYCGTWDSSLGAPYVFGTGTKVTVLGSRGGGGSGGG
GSGGGGSLEMAEVQLVQSWGGSEQPGRSLRLSCAASGFTFDDYAMHWVRQAPGKGLEW
VSGISWNSGSIGYADSVKGRFTISRDNAKNSLYLQMNSLRAEDTAMYYCARYRQVGSAY
DSWGQGTLVTVSSTSGQAGQHHHHHHGAYPYDVPDYAS [SEQ ID NO: 632]

TABLE 97

ET200-023
DNA Sequence
ctgcctgtgctgactcagccaccctcggtgtcagtggccccaggaaagacggccaggattacctgtgggggaaacaacattggaagtaaaagt
gtgcactggtatcagcagaagccaggccaggcccctgtgctggtcgtctatgctgatagcgaccggccctcagggatccctgagcgattctctg
gctccaactctgggaacacggccaccctgaccatcagcagggtcgaagccggggatgaggccgactattactgtcaggtgtgggatagtagt
agttatcataattatgtcttcggaactgggaccaaggtcaccgtcctaggttctagaggtggtggtggtagcggcggcggcggctctggtggtgg
tggatccctcgagatggccgaggtgcagctggtgcagtctggagctgaggtgaagaagcctggggcctcagtgaaggtctcctgcaaggctt
ctggttacaccttaccagctatggtatcagctgggtgcgacaggcccctggacaagggcttgagtggatgggatggatcagcgcttacaatgg
taacacaaactatgcacagaagctccagggcagagtcaccatgaccacagacacatccacgagcacagcctacatggagctgagcagcctg
agatctgaggacaccgccatgtattactgtgcgcgctactggggtttcggtgtttctgatcgttggggtcaaggtactctggtgaccgtctcctc
aactagtggccaggccggccagcaccatcaccatcaccatggcgcatacccgtacgacgttccggactacgcttct [SEQ ID NO: 633]

Amino Acid Sequence
LPVLTQPPSVSVAPGKTARITCGGNNIGSKSVHWYQQKPGQAPVLVVYADSDRPSGIPERF
SGSNSGNTATLTISRVEAGDEADYYCQVWDSSSYHNYVFGTGTKVTVLGSRGGGGSGGG
GSGGGGSLEMAEVQLVQSGAEVKKPGASVKVSCKASGYTFTSYGISWVRQAPGQGLEW
MGWISAYNGNTNYAQKLQGRVTMTTDTSTSTAYMELSSLRSEDTAMYYCARYWGFGVS
DRWGQGTLVTVSSTSGQAGQHHHHHHGAYPYDVPDYAS [SEQ ID NO: 634]

TABLE 98

ET200-024
DNA Sequence
aatttatgctgactcagccccactctgtgtcggagtctccggggaagacggtaaccatctcctgcaccggcagcagtggcagcattgccagca
actatgtgcagtggtaccagcagcgcccgggcagtgcccccaccactgtgatctatgaggataaccaaagaccctctggggtccccgatcggt
tctctggctccatcgacagctcctccaactctgcctccctcaccatctctggactggactgaggacgaggctgactactactgtcagtctta
tgacagcagcaatctttgggtgttcggcggagggaccaagctgaccgtcctaggttctagaggtggtggtggtagcggcggcggcggctctggtg
gtggtggatccctcgagatggcccagatgcagctggtgcagtctggggctgaggtgaagaagcctgggtcctcggtgaaggtctcctgcaag
gcttctggaggcaccttcagcagctatgctatcagctgggtgcgacaggcccctggacaagggcttgagtggatgggagggatcatccctatct
ttggtacagcaaactacgcacagaagttccagggcagagtcacgattaccgcggacgaatccacgagcacagcctacatggagctgagcag
cctgagatctgaggacactgccgtgtattactgtgcgcgctacaactactactactacgattcttggggtcaaggtactctggtgaccgtctcct
caactagtggccaggccggccagcaccatcaccatcaccatggcgcatacccgtacgacgttccggactacgcttct [SEQ ID NO: 635]

Amino Acid Sequence
NFMLTQPHSVSESPGKTVTISCTGSSGSIASNYVQWYQQRPGSAPTTVIYEDNQRPSGVPDR
FSGSIDSSSNSASLTISGLKTEDEADYYCQSYDSSNLWVFGGGTKLTVLGSRGGGGSGGGG
SGGGGSLEMAQMQLVQSGAEVKKPGSSVKVSCKASGGTFSSYAISWVRQAPGQGLEWM
GGIIPIFGTANYAQKFQGRVTITADESTSTAYMELSSLRSEDTAVYYCARYNYYYDSWGQ
GTLVTVSSTSGQAGQHHHHHHGAYPYDVPDYAS [SEQ ID NO: 636]

TABLE 99

ET200-025
DNA Sequence
gacatccagatgacccagtctccatcctccctgtctgcatctgtaggagacagagtcaccatcacttgccgggcaagtcagagcattagcagcta
tttaaattggtatcagcagaaaccagggaaagcccctaagctcctgatctatgctgcatccagtttgcaaagtggggtcccatcaaggttcagt
ggcagtggatctgggacagatttcactctcaccatcagcagtctgcaacctgaagattttgcaacttactactgtcaacagagttacagtaccc
cattcacttcggccctgggaccaaagtggatatcaaacgttctagaggtggtggtggtagcggcggcggcggctctggtggtggtggatccctc
gagatggccgaggtgcagctggtgcagtctggggctgaggtgaagaagcctgggtcctcggtgaaggtctcctgcaaggcttctggaggccct
tcagcagctatgctatcagctgggtgcgacaggcccctggacaagggcttgagtggatgggagggatcatccctatctttggtacagcaaactac
gcacagaagttccagggcagagtcacgattaccgcggacgaatccacgagcacagcctacatggagctgagcagcctgagatctgaggaca
ccgccatgtattactgtgcgcgctactgggttacgactcttacgatgaatggggtcaaggtactctggtgaccgtctcctcaactagtggcca
ggccggccagcaccatcaccatcaccatggcgcatacccgtacgacgttccggactacgcttct [SEQ ID NO: 637]

Amino Acid Sequence
DIQMTQSPSSLSASVGDRVTITCRASQSISSYLNWYQQKPGKAPKLLIYAASSLQSGVPSRF
SGSGSGTDFTLTISSLQPEDFATYYCQQSYSTPFTFGPGTKVDIKRSRGGGGSGGGGSGGGG
SLEMAEVQLVQSGAEVKKPGSSVKVSCKASGGTFSSYAISWVRQAPGQGLEWMGGIIPIFG
TANYAQKFQGRVTITADESTSTAYMELSSLRSEDTAMYYCARYWGYDSYDEWGQGTLVT
VSSTSGQAGQHHHHHHGAYPYDVPDYAS [SEQ ID NO: 638]

TABLE 100

ET200-026
DNA Sequence
aatttatgctgactcagccccactctgtgtcggagtctccggggaagacggtaaccatctcctgcaccggcagcagtggcagcattgccagca actatgtgcagtggtaccagcagcgcccgggcagtgcccccaccactgtgatctatgaggataaccaaagaccctctggggtccctgatcggtt ctctggctccatcgacagctcctccaactctgcctccctcaccatctctggactgaagactgaggacgaggctgactactactgtcagtcttat gatagcagcaatgggtgttcggcggagggaccaagctgaccgtcctaggttctagaggtggtggtggtagcggcggcggcggctctggtggtgg tggatccctcgagatggccgaggtccagctggtgcagtctggggctgaggtgaagaagcctgggtcctcggtgaaggtctcctgcaaggcttc tggaggcaccttcagcagctatgctatcagctgggtgcgacaggcccctggacaagggcttgagtggatgggagggatcatccctatctttggt acagcaaactacgcacagaagttccagggcagagtcacgattaccgcggacgaatccacgagcacagcctacatggagctgagcagcctga gatctgaggacacggccgtgtattactgtgcgcgcaacaaccattacaaacgattactggggtcaaggtactctggtgaccgtctcctcaact agtggccaggccggccagcaccatcaccatcaccatggcgcatacccgtacgacgttccggactacgcttct [SEQ ID NO: 639]

Amino Acid Sequence
NFMLTQPHSVSESPGKTVTISCTGSSGSIASNYVQWYQQRPGSAPTTVIYEDNQRPSGVPDR

FSGSIDSSSNSASLTISGLKTEDEADYYCQSYDSSNWVFGGGTKLTVLGSRGGGGSGGGGS

GGGGSLEMAEVQLVQSGAEVKKPGSSVKVSCKASGGTFSSYAISWVRQAPGQGLEWMGG

IIPIFGTANYAQKFQGRVTITADESTSTAYMELSSLRSEDTAVYYCARNNHYYNDYWGQGT

LVTVSSTSGQAGQHHHHHHGAYPYDVPDYAS [SEQ ID NO: 640]

TABLE 101

ET200-027
DNA Sequence
cagtctgtgttgacgcagccgccctcagtgtctggggccccagggcaggggtcaccatccctgcactgggagcagctccaacatcggggcaggttatgatgtacactggtaccagcagcttccagggacagccccaaactcctcatctatggtaacaacaatcggccctcaggggtccctgaccgcttctctggctccaggtctggctcctcagcctccctggccatcactgggctccaggctgaggatgaggctgattattactgccagtcctatgacagcagcctgagtgatgtggtattcggcggagggaccaaggtcaccgtcctaggttctagaggtggtggtggtagcggcggcggcggctctgGtggtggtggatccctcgagatggccgaggtccagctggtgcagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccatcaccgacacgtctacagacacagcctacatggagctgagcagcctgagatctgaggacacggccgtgtattactgtgcgcgctactggtcttactctttcgactacctgtacatgccggaagtaacgattggtgggtcaaggtactctggtgaccgtctcctcaactagtggccaggccggccagcaccatcaccatcaccatggcgcatacccgtacgacgttccggactacgcttct [SEQ ID NO: 641]

Amino Acid Sequence
QSVLTQPPSVSGAPGQGVTIPCTGSSSNIGAYDVHWYQQLPGTAPKLLIYGNNNRPSGVP
DRFSGSRSGSSASLAITGLQAEDEADYYCQSYDSSLSDVVFGGGTKVTVLGSRGGGGSGG
GGSGGGGSLEMAEVQLVQSGAEVKKPGATVKISCKVSGYTFTDYYMHWVQQAPGKGLE
WMGLVDPEDGETIYAEKFQGRVTITADTSTDTAYMELSSLRSEDTAVYYCARYWSYSFDY
LYMPEGNDWWGQGTLVTVSSTSGQAGQHHHHHHGAYPYDVPDYAS [SEQ ID NO: 642]

TABLE 102

ET200-028
DNA Sequence
cagtctgtgttgactcagccacccgcagcgtctggggaccccggacagagagtcaccatctcttgttctggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggcccaggtccagctggtacagtctggagctgaggtgaagaagcctgggattcagtgaaggtctcctgcaagcttctggttacaatttttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgcgacctgtactactacgaaggtgtttgattactgggtcaaggtactctggtgaccgtctcctcaactagtggccaggccggccagcaccatcaccatcaccatggcgcatacccgtacgacgttccggactacgcttct [SEQ ID NO: 643]

Amino Acid Sequence
QSVLTQPPAASGTPGQRVTISCSGGVSNIGSGALNWYQQLPGTAPKLLIYSYNQRPSGVSD
RFSGSRSATSASLAISGLQSEDEADYYCATWDDSVNGWVFGGGTKLTVLGSRGGGGSGG
GGSGGGGSLEMAQVQLVQSGAEVKKPGDSVKVSCKPSGYNFLNYGINWVRQAPGQGLE
WMGWISTYTGNTNYAQKLQGRVTFTTDTSTSTAYMEMRSLRSDDTAVYYCARDLYYYE
GVDYWGQGTLVTVSSTSGQAGQHHHHHHGAYPYDVPDYAS [SEQ ID NO: 644]

TABLE 103

ET200-029
DNA Sequence
caggctgtgctgactcagccaccctcagtgtcagtggccccaggaaagacggccagggttacctgtgggggaaacaacattggaagtgaaagtgtgcactggtaccagcagaagccaggccaggcccctgtgttggtcatctattatgataccgaccggccctcagggatccctgagcgattctctggctcccactctgggaccacggccaccctgaccatcagcagggtcgaagccggggatgaggccgactattactgtcaggtgtgggatagtagtagggatcatgtggtattcggcggagggaccaagctgaccgtcctaggttctagaggtggtggtggtagcggcggcggcggctctggtggtggtggatccctcgagatggcccaggtgcagctggtgcagtctgggggaggcgtggtccagcctggggaggtccctgagactcctgtgcggcctctggattcaccttcagtagctatgctatgcactgggtccgccaggctccaggcaagggactggagtgggtggcagttatatcatatgatggaagcaataaatactacgcagactccgtgaagggccgattcaccatctccagagacaattccaagaacacgctgtatctgcaaatgaacagcctgagagctgaggacacggccgtgtattactgtgcgcgctcttacttcacttctggtttctacgattactggggtcaaggtactctggtgaccgtctcctcaactagtggccaggccggccagcaccatcaccatcaccatggcgcatacccgtacgacgttccggactacgcttct [SEQ ID NO: 645]

Amino Acid Sequence

QAVLTQPPSVSVAPGKTARVTCGGNNIGSESVHWYQQKPGQAPVLVIYYDTDRPSGIPERF

SGSHSGTTATLTISRVEAGDEADYYCQVWDSSRDHVVFGGGTKLTVLGSRGGGGSGGGG

SGGGGSLEMAQVQLVQSGGGVVQPGRSLRLSCAASGFTFSSYAMHWVRQAPGKGLEWV

AVISYDGSNKYYADSVKGLFTISRDNSKNTLYLQMNSLRAEDTAVYYCARSYFTSGFYDY

WGQGTLVTVSSTSGQAGQHHHHHHGAYPYDVPDYAS [SEQ ID NO: 646]

TABLE 104

ET200-030
DNA Sequence
cagtctgtcgtgacgcagccgccctcagtgtctggggccccagggcagagggtcaccatctcctgcactgggagcagttccaacatcggggc
aggttatgatgtaaattggtatcagcagtttccaggaacagccccaaactcctcatctatggtaacagcaatcggccctcagggtccctgacc
gattctctggctccaagtctggcacctcagcctccctggcctcctcccaggctgaggatgaggctgattattactgccagtcctatga
cagcagcctgagtggctcttatgtcttcggaactgggaccaaggtcaccgtcctaggtctagaggtggtggtggtagcggcggcggctctg
gtggtggtggatccctcgagatggcccagatgcagctggtgcagtctggggctgaggtgaagaagcctggggcctcagtgaaggtctcctgc
aaggcttccggatacacccctcactgaattatccatgcactgggtgcgacaggctcctggaaaagggcttgagtggatgggaggttttgatcctga
agatggtgaaacaatctacgcacagaagttccagggcaggtcaccatgaccgaggacacatctacagacacagcctacatggagctgagca
gcctgagatctgaggacactgccgtgtattactgtgcgcgcatgtcttctatgtactacgattgggtcaaggtactctggtgaccgtctcctca
actagtggccaggccgccagcaccatcaccatcaccatggcgcatacccgtacgacgttccggactacgcttct [SEQ ID NO: 647]

Amino Acid Sequence
QSVVTQPPSVSGAPGQRVTISCTGSSSNIGAYDVNWYQQFPGTAPKLLIYGNSNRPSGVP
DRFSGSKSGTSASLAITGLQAEDEADYYCQSYDSSLSGSYVFGTGTKVTVLGSRGGGGSGG
GGSGGGGSLEMAQMQLVQSGAEVKKPGASVKVSCKASGYTLTELSMHWVRQAPGKGLE
WMGGFDPEDGETIYAQKFQGRVTMTEDTSTDTAYMELSSLRSEDTAVYYCARMSSMYYD
WGQGTLVTVSSTSGQAGQHHHHHHGAYPYDVPDYAS [SEQ ID NO: 648]

TABLE 105

ET200-031
DNA Sequence
tcctatgtgctgactcagccaccctcagtgtcagtggccccaggaaagacggccaggattacctgtgggggaaacaacattggaagtaaaagt
gtgcactggtaccagcagaagccaggccaggcccctgtgctggtcatctattatgatagcgaccggccctcagggatccctgagcgattctctg
gctccaactctgggaacacggcccacctgaccatcagcagggtcgaagccggagacgccgactattactgtcaggtgtgggatagtagt
agtgattatgtcttcggaactgggaccaaggtcaccgtcctaggtctagaggtggtggtggtagcggcggcggcggctctggtggtggtggat
ccctcgagatggccgaggtgcagctggtggagactggggggaggcttggtcaagcctggagggtccctgagactctcctgtgcagcctctgga
ttcaccgtcagtgactactacatgagctggatccgccaggctccagggaagggcctggagtggatttcatacattagtggtagtggtaatagcat
atactacgcagactctgtgaagggccgattcaccatctccagggacaacgccaagaactcactggatctgcaaatgaccagcctgagagcga
ggacacggccgtatattactgtgcgcgctctactaaattcgattactgggtcaaggtactctggtgaccgtctcctcaactagtggccaggccg
gccagcaccatcaccatcaccatggcgcatacccgtacgacgttccggactacgcttct [SEQ ID NO: 649]

Amino Acid Sequence
SYVLTQPPSVSVAPGKTARITCGGNNIGSKSVHWYQQKPGQAPVLVIYYDSDRPSGIPERFS
GSNSGNTATLTISRVEAGDEADYYCQVWDSSSDYVFGTGTKVTVLGSRGGGGSGGGGSG
GGGSLEMAEVQLVETGGGLVKPGGSLRLSCAASGFTVSDYYMSWIRQAPGKGLEWISYIS
GSGNSIYYADSVKGRFTISRDNAKNSLDLQMTSLRAEDTAVYYCARSTKFDYWGQGTLVT
VSSTSGQAGQHHHHHHGAYPYDVPDYAS [SEQ ID NO: 650]

TABLE 106

ET200-032
DNA Sequence
ctgcctgtgctgactcagccaccctcagcgtctgggaccccggggcagagggtcaccatctcttgttctggaagcagctccaacgtcggaagtt
acactgtaaactggtaccggcaactcccaggaacggcccccacactcctcatctataataataatcagcggccctcaggggtccctgaccgatt
ctctgactccaagtctggcacctcggcctccctgaccattagtgggctccagcctgaggatgaggctgattattattgtgcagcatgggatgaca
ggctgggtggttatgtcttcggaactgggaccaaggtcaccgtcctaggttctagaggtggtggtggtagcggcggcggcggctctggtggtg
gtggatccctcgagatggccgaggtgcagctggtgcagtctggagcagaggtgaaaaagccgggggagtctctgaagatctcctgtaagggt
tctggatacagcttaccaactactggatcggctgggtgcgccagatgcccgggaaaggcctggagtggatggggatcatctatcctggtgact
ctgataccagatacagcccgtccttccaaggccaggtcaccatctcagccgacaagtccatcagcaccgcctacctacagtggagcagcctga
aggcctcggacaccgccatgtattactgtgcgcgctctactggttcttctcatatgtctgatgaatgggtcaaggtactctggtgaccgtctcc
tcaactagtggccaggccggccagcaccatcaccatcaccatggcgcatacccgtacgacgttccggactacgcttct [SEQ ID NO: 651]

Amino Acid Sequence
LPVLTQPPSASGTPGQRVTISCSGSSSNVGSYTVNWYRQLPGTAPTLLIYNNNQRPSGVPDR
FSDSKSGTSASLTISGLQPEDEADYYCAAWDDRLGGYVFGTGTKVTVLGSRGGGGSGGGG
SGGGGSLEMAEVQLVQSGAEVKKPGESLKISCKGSGYSFTNYWIGWVRQMPGKGLEWM
GIIYPGDSDTRYSPSFQGQVTISADKSISTAYLQWSSLKASDTAMYYCARSTGSSHMSDEW
GQGTLVTVSSTSGQAGQHHHHHHGAYPYDVPDYAS [SEQ ID NO: 652]

TABLE 107

ET200-033
DNA Sequence
aattttatgctgactcagcccactctgtgtcggagtctccggggaagacggtaaccatctcctgcaccggcagcagtggcagcattgccagca
actatgtgcagtggtaccagcagcgcccgggcagtgcccccaccactgtgatctatgaggataaccaaagaccctctggggtccctgatcggtt
ctctggctccatcgacagctcctccaactctgcctccctcaccatctctggactgaagactgaggacgaggctgactactactgtcagtcttat
gatagcagcaatcattgggtgttcggcggagggaccaagctgaccgtcctaggttctagaggtggtggtggtagcggcggcggcggctctggtgg
tggtggatccctcgagatggcccaagtgcagctacagcagtggggcgcaggactgttgaagcttcggagaccctgtccctcacctgcgctgt
ctatggtgggtccttcagtggttactactggagctggatccgccagccccagggaaggggctgagtggattggggagatcactcatagtgg
aaggtccaactacaacccgtccctcaagagtcgagtcaccatatcagtagacacgtccaagaaccagttctccctgaagctgagctctgtgacc
gccgcggacacggccgtgtattactgtgcgcgctcttctatcatgtctgattactgggctcaaggtactctggtgaccgtctcctcaactagtg
gccaggccggccagcaccatcaccatcaccatggcgcatacccgtacgacgttccggactacgcttct [SEQ ID NO: 653]

Amino Acid Sequence
NFMLTQPHSVSESPGKTVTISCTGSSGSIASNYVQWYQQRPGSAPTTVIYEDNQRPSGVPDR
FSGSIDSSSNSASLTISGLKTEDEADYYCQSYDSSNHWVFGGGTKLTVLGSRGGGGSGGGG
SGGGGSLEMAQVQLQQWGAGLLKPSETLSLTCAVYGGSFSGYYWSWIRQPPGKGLEWIG
EITHSGRSNYNPSLKSRVTISVDTSKNQFSLKLSSVTAADTAVYYCARSSIMSDYWGQTL
VTVSSTSGQAGQHHHHHGAYPYDVPDYAS [SEQ ID NO: 654]

TABLE 108

ET200-034
DNA Sequence
cagtctgtgttgacgcagccgccctcagtgtctggggcccagggcagagggtcaccatctcctgcactgggagcacctccaacatcggggc
aggttatgatgtacactggtaccagcagcttccaggaacagcccccaaactcctcatcaacaataacaggaatcggccctcaggggtccctgac
cgattctctggctccaagtctgggcacgtcagccaccctgggcatcaccggactccagactggggacggaggccgattattactgcggaacatgg
gatgcagcctgactggtgcagtgttcggcggagggaccaagctgaccgtcctaggttctagaggtggtggtggtagcggcggcggcggct
ctggtggtggtggatccctcgagatggccgaggtccagctggtgcagtctggggctgaggtgaagaagcctgggtcctcggtgaaggtctcat
gcaaggcttctggaggcaccttcagcagctatgctatcagctgggtgcgacaggcccctggacaagggcttgagtggatgggagggatcatc
cctatctttggtacagcaaactacgcacagaagttccagggcagagtcacgattaccgcggacgaatccacgagcacagcctacatggagctg
agcagcctgagatctgaggacacggccgtgtattactgtgcgcgcggttctgctctggaccattacgatcgttgggtcaaggtactctggtgac
cgtctcctcaactagtggccaggccggccagcaccatcaccatcaccatggcgcatacccgtacgacgttccggactacgcttct [SEQ ID NO: 655]

Amino Acid Sequence
QSVLTQPPSVSGAPGQRVTISCTGSTSNIGAGYDVHWYQQLPGTAPKLLINNNRNRPSGVP
DRFSGSKSGTSATLGITGLQTGDEADYYCGTWDGSLTGAVFGGGTKLTVLGSRGGGGSGG
GGSGGGGSLEMAEVQLVQSGAEVKKPGSSVKVSCKASGGTFSSYAISWVRQAPGQGLEW
MGGIIPIFGTANYAQKFQGRVTITADESTSTAYMELSSLRSEDTAVYYCARGSALDHYDRW
GQGTLVTVSSTSGQAGQHHHHHGAYPYDVPDYAS [SEQ ID NO: 656]

TABLE 109

ET200-035
DNA Sequence
aattttatgctgactcagcccactctgtgtcggagtctccggggaagacggtaaccatctcctgcaccggcagcagtggcagcattgccagca
actatgtgcagtggtaccagcagcgcccgggcagtgcccccaccactgtgatctatgaggataaccaaagaccctctggggtccctgatcggtt
ctctggctccatcgacagctcctccaactctgcctccctcaccatctctggactgaagactgaggacgaggctgactactactgtcagtcttat
gatagcaccaattgggtgttcggcggagggaccaagctgaccgtcctaggttctagaggtggtggtggtagcggcggcggcggctctggtggtgg
tggatccctcgagatggcccaggtgcagctggtgcagtctggggctgaggtgaagaagcctgggtcctcggtgaaggtctcctgcaaggcttc
tggaggcaccttcagcagctatgctatcagctgggtgcgacaggcccctggacaagggcttgagtggatgggagggatcatccctatctttggt
acagcaaactacgcacagaagtccagggcagagtcacgattaccgcggacgaatccacgagcacagcctacatggagctgagcagcctga
gatctgaggacactgccgtgtattactgtgcgcgctacaactactacttcaacgattactgggtcaaggtactctggtgaccgtctcctcaa
ctagtggccaggccggccagcaccatcaccatcaccatggcgcatacccgtacgacgttccggactacgcttct [SEQ ID NO: 657]

Amino Acid Sequence
NFMLTQPHSVSESPGKTVTISCTRSSGSIASNYVQWYQQRPGSAPTTVIYEDNQRPSGVPDR
FSGSIDSSSNSASLTISGLKTEDEADYYCQSYDSTNWVFGGGTKLTVLGSRGGGGSGGGGS
GGGGSLEMAQVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARYNYYFNDYWGQG
TLVTVSSTSGQAGQHHHHHGAYPYDVPDYAS [SEQ ID NO: 658]

TABLE 110

ET200-037
DNA Sequence
tcctatgtgctgactcagccaccctcagtgtcagtggccccaggaaagacggccaggattacctgtgggggaaacaacattggaagtaaaagt
gtgcactggtaccagcagaagccaggccaggcccctgtgctggtcatctattatgatagcgaccggccctcagggatccctgagcgattctctg
gctccaactctgggaacacggccaccctgaccatcagcagggtcgaagccggggatgagcgactattactgtcaggtgtgggatagtagt
agtgatcatccttatgtcttcggaactgggaccaaggtcaccgtcctaggttctagaggtggtggtggtagcggcggcggcggctctggtggtg
gtggatccctcgagatggcccagatgcagctggtgcagtctggagctgaggtgaagaagcctggggcctcagtgaaggtctcctgcaaggctt
ctggttacacctttaccagctatggtatcagctgggtgcgacaggcccctggacaagggcttgagtggatgggatggatcagcgcttacaatgg
taacacaaactatgcacagaagctccagggcagagtcaccatgaccacagacacatccacgagcacagcctacatggagctgaggagcctg
agatctgacgacactgccgtgtattactgtgcgcgctctatgttcggtgctcatgattcttgggtcaaggtactctggtgaccgtctcctcaa
ctagtggccaggccggccagcaccatcaccatcaccatggcgcatacccgtacgacgttccggactacgcttct [SEQ ID NO: 659]

Amino Acid Sequence
SYVLTQPPSVSVAPGKTARITCGGNNIGSKSVHWYQQKPGQAPVLVIYYDSDRPSGIPERFS
GSNSGNTATLTISRVEAGDEADYYCQVWDSSSDHPYVFGTGTKVTVLGSRGGGSGGGG
SGGGGSLEMAQMQLVQSGAEVKKPGASVKVSCKASGYTFTSYGISWVRQAPGQGLEWM
GWISAYNGNTNYAQKLQGRVTMTTDTSTSTAYMELRSLRSDDTAVYYCARSMFGAHDS
WGQGTLVTVSSTSGQAGQHHHHHHGAYPYDVPDYAS [SEQ ID NO: 660]

TABLE 111

ET200-038
DNA Sequence
cagtctgtgttgacgcagccgccctcagtgtctggggcccagggcagagggtcaccatctcctgcactgggagcagctccaacatcggggc
aggttttgatgtacactggtaccagctacttccaggaacagcccccaaactcctcatctatgctaacagcaatcggccctcaggggtccctgacc
gattctctggctccaagtctggcacctcagcctccctggcccatcacctgggctccggctggcagtgaggctgattattactgccagtcctatga
cagcagcctgagtggtgtggtattcggcggagggaccaagctgaccgtcctaggttctagaggtggtggtggtagcggcggcggcggctctggt
ggtggtggatccctcgagatggcccaggtgcagctggtgcaatctggggctgaggtgaagaagcctgggtcctcggtgaaggtctcctgcaa
ggcttctggaggcaccttcagcagctatgctatcagctgggtgcgacaggcccctggacaagggcttgagtggatgggagggatcatccctat
ctttggtacagcaaactacgcacagaagttccagggcagagtcacgattaccgcggacgaatccacgagcacagcctacatggagctgagca
gcctgagatctgaggacactgccgtgtattactgtgcgcgcggtgcttcttttcgacgtcatgataactggggtcaaggtactctggtgaccgt
ctcctcaactagtggccaggccggccagcaccatcaccatcaccatggcgcatacccgtacgacgttccggactacgcttct [SEQ ID NO: 661]

Amino Acid Sequence
QSVLTQPPSVSGAPGQRVTISCTGSSSNIGAGFDVHWYQLLPGTAPKLLIYANSNRPSGVPD
RFSGSKSGTSASLAITGLLAEDEADYYCQSYDSSLSGVVFGGGTKLTVLGSRGGGSGGGG
SGGGGSLEMAQVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARGASFDRHDNWGQ
GTLVTVSSTSGQAGQHHHHHHGAYPYDVPDYAS [SEQ ID NO: 662]

TABLE 112

ET200-039
DNA Sequence
aattttatgctgactcagccccactctgtgtcggagtctccggggaagacggtaaccatctcctgcacccgcagcagtggcagcattgccagca
actatgtgcagtggtaccagcagcgcccgggcagttcccccaccactgtgatctatgaggataaccaaagaccctctgggtccctgatcggtt
ctctggctccatcgacagctcctccaactctgctccctcaccatctctggactgaagactgaggacgaggctgactactactgtcagtctta
tgatagcagcaattgggtgttcggcggagggaccaagctgaccgtcctaggttctagaggtggtggtggtagcggcggcggcggctctggtggtg
gtggatccctcgagatggccgaggtccagctggtgcagtctggggctgaggtgaagaagcctgggtcctcggtgaaggtctcctgcaaggcttc
tggaggcaccttcagcagctatgctatcagctgggtgcgacaggcccctggacaagggcttgagtggatgggagggatcatccctatctttggt
acagcaaactacgcacagaagttccagggcagagtcacgattaccgcggacgaatccacgagcacagcctacatggagctgagcagcctga
gatctgaggacacgccgtgtattactgtgcgcgctctaactactactacaacgattactggggtcaaggtactctggtgaccgtctcctcaac
tagtggccaggccggccagcaccatcaccatcaccatggcgcatacccgtacgacgttccggactacgcttct [SEQ ID NO: 663]

Amino Acid Sequence
NFMLTQPHSVSESPGKTVTISCTRSSGSIASNYVQWYQQRPGSSPTTVIYEDNQRPSGVPDR
FSGSIDSSNSASLTISGLKTEDEADYYCQSYDSSNWVFGGGTKLTVLGSRGGGSGGGGS
GGGGSLEMAEVQLVQSGAEVKKPGSSVKVSCKASGGTFSSYAISWVRQAPGQGLEWMGG
IIPIFGTANYAQKFQGRVTITADESTSTAYMELSSLRSEDTAVYYCARSNYYYNDYWGQGT
LVTVSSTSGQAGQHHHHHHGAYPYDVPDYAS [SEQ ID NO: 664]

TABLE 113

ET200-040
DNA Sequence
cagtctgtgttgacgcagccgccctcagtgtctggggccccagggcagagggtcaccatctcctgcactgggagcagctccaacatcgggc
aggttatgatgtacactggtaccagcagcttccaggaacagcccccaaactcctcatctatggtaacagcaatcggccctcaggggtccctgac
cgattctctggctccaagtctggcacctcagcctccctggccatcactgggctccaggctgaggatgaggctgattattactgccagtcctatga
cagcagcctgagtggttatgtcttcggaactgggaccaaggtcaccgtcctaggttctagaggtggtggtggtagcggcggcggcggctctggt
ggtggtggatccctcgagatggcccaggtgcagctggtgcagtctggggctgaggtgaagaagcctggggcctcagtgaaggtctcctgcaa
ggtttccggatacaccctcactgaattatccatgcactgggtgcgacaggctcctggaaaagggcttgagtggatgggaggttttgatcctgaag
atggtgaaacaatctacgcacagaagttccagggcagagtcaccatgaccgaggacacatctacagacacagcctacatggagctgagcagc
ctgagatctgaggacactgccgtgtattactgtgcgcgctactctggtgtttactacgattggggtcaaggtactctggtgaccgtctcctcaa
ctagtggccaggccggccagcaccatcaccatcaccatggcgcatacccgtacgacgttccggactacgcttct [SEQ ID NO: 665]

Amino Acid Sequence
QSVLTQPPSVSGAPGQRVTISCTGSSSNIGAYDVHWYQQLPGTAPKLLIYGNSNRPSGVP
DRFSGSKSGTSASLAITGLQAEDEADYYCQSYDSSLSGYVFGTGTKVTVLGSRGGGGSGG
GGSGGGGSLEMAQVQLVQSGAEVKKPGASVKVSCKVSGYTLTELSMHWVRQAPGKGLE
WMGGFDPEDGETIYAQKFQGRVTMTEDTSTDTAYMELSSLRSEDTAVYYCARYSGVYYD
WGQGTLVTVSSTSGQAGQHHHHHHGAYPYDVPDYAS [SEQ ID NO: 666]

TABLE 114

ET200-041
DNA Sequence
aatttatgctgactcagccccactctgtgtcggggtctccggggaagacggtaaccatctcctgcaccggcagcagtggcagcattgccgaca
actttgtgcagtggtaccagcagcgcccgggcggtgtccccaccactgtgatctttaatgatgacgaaagaccctctggcgtccctgatcggttc
tctggctccatcgacacctcctccaattctgcctccctccaccatctctggactgaagactgaggacgaggctgactactactgtcagtcttatga
taataataatcgaggggtgttcggcggagggaccaagctgaccgtcctaggttctagaggtggtggtggtagcggcggcggcggctctggtggt
ggtggatccctcgagatggcccaggtccagctggtgcagtctggggctgaggtgaagaagcctgggtcctcggtgaaggtctcctgcaaggc
ttctggaggcaccttcagcagctatgctatcagctgggtgcgacaggcccctggacaagggcttgagtggatgggatggatgaaccctaacag
tggtaacacaggctatgcacagaagttccagggcagagtcaccatgaccaggaacacctccataagcacagcctacatggagctgagcaacc
tgagatctgaggacacggccgtgtattactgtgcgcgctactactcttacggttacgattggggtcaaggtactctggtgaccgtctcctcaac
tagtggccaggccggccagcaccatcaccatcaccatggcgcatacccgtacgacgttccggactacgcttct [SEQ ID NO: 667]

Amino Acid Sequence
NFMLTQPHSVSGSPGKTVTISCTGSSGSIADNFVQWYQQRPGGVPTTVIFNDDERPSGVPD
RFSGSIDTSSNSASLTISGLKTEDEADYYCQSYDNNNRGVFGGGTKLTVLGSRGGGGSGGG
GSGGGGSLEMAQVQLVQSGAEVKKPGSSVKVSCKASGGTFSSYAISWVRQAPGQGLEWM
GWMNPNSGNTGYAQKFQGRVTMTRNTSISTAYMELSNLRSEDTAVYYCARYSYGYDW
GQGTLVTVSSTSGQAGQHHHHHHGAYPYDVPDYAS [SEQ ID NO: 668]

TABLE 115

ET200-042
DNA Sequence
cagtctgtcgtgacgcagccgccctcagtgtctggggccccagggcagacggtcaccatctcctgcactgggggcagctccaacatcgggac
aggttatttttgtaaattggtaccagcaggttccaggaaaagcccccaaactcctcatcctgggtaacaataatcggccctcgggggtccctgacc
gactctccggctccacgtccggcacctcagcctccctggccatcactgggctccaggctgaggatgagggtacttattactgccagtcctatgac
agcagcctgagtggttatgtcttcggaactgggaccaaggtcaccgtcctaggttctagaggtggtggtggtagcggcggcggcggctctggt
ggtggtggatccctcgagatggcccaggtacagctgcagcagtcaggtccaggactggtgaagccctcgcagaccctctcactcacctgtgg
catctccggggacagtgtctctaccaacagtgttgcttggcactggatcaggcagtcccatcgagaggccttgagtggctgggaaggacatac
tacaggtccaagtggtctaatgactatggagtatctgtgaaaagtcgaatcaccatcatcccagacacatccaagaaccagttctccctgcagc
tgaactctgtgactcccgaggacacggctgtgtattactgtgcgcgctcttcttcttggtaccagatcttcgattactggggtcaaggtactct
ggtgaccgtctcctcaactagtggccaggccggccagcaccatcaccatcaccatggcgcatacccgtacgacgttccggactacgcttct
[SEQ ID NO: 669]

Amino Acid Sequence
QSVVTQPPSVSGAPGQTVTISCTGSSSNIGTGYFVNWYQQVPGKAPKLLILGNNNRPSGVP
DRLSGSTSGTSASLAITGLQAEDEGTYYCQSYDSSLSGYVFGTGTKVTVLGSRGGGGSGGG
GSGGGGSLEMAQVQLQQSGPGLVKPSQTLSLTCGISGDSVSTNSVAWHWIRQSPSRGLEW
LGRTYYRSKWSNDYGVSVKSRITIIPDTSKNQFSLQLNSVTPEDTAVYYCARSSSWYQIFD
YWGQGTLVTVSSTSGQAGQHHHHHHGAYPYDVPDYAS [SEQ ID NO: 670]

TABLE 116

ET200-043
DNA Sequence
aatttttatgctgactcagcccactctgtgtcggagtctccggggaagacggtaaccatctcctgcaccggcagcagcgacagcatagccaaca
actatgttcagtggtaccagcagcgcccggcagtgcccccaccaatgtgatctacgaagatgtccaaagaccctctgggtccctgatcggtt
ctctgggtccatcgacagctcctccaactctgcctccctcaccatctctggactgaagactgaggacgaggctgtctactattgtcagtctta
tcatagcgacaatcgttgggtgttcggcggcgggaccaagctgaccgtcctaggttctagaggtggtggtggtagcggcggcggcggctctggt
ggtggtggatcccctcgagatggcccaggtgcagctggtgagtctggggggaggcttggtacagcctgggggtcctgagactctcctgtgcag
cctctggattcacctttagcagctatgccatgagctgggtccgccaggctccagggaaggggctggagtgggtctcagctattagtggtagtggt
ggtagcacatactacgcagactccgtgaagggccggttcaccatctccagagacaattccaagaacacgctgtatctgcaaatgaacagcctg
agagccgaggacacggccgtatattactgtgcgcgctctggtgcttactgggactactctgtttacgatgaatggggtcaaggtactctggtgac
cgtctcctcaactagtggccaggccggccagcaccatcaccatcaccatggcgcatacccgtacgacgttccggactacgcttct [SEQ ID
NO: 671]

Amino Acid Sequence
NFMLTQPHSVSESPGKTVTISCTGSSDSIANNYVQWYQQRPGSAPTNVIYEDVQRPSGVPD
RFSGSIDSSSNSASLTISGLKTEDEAVYYCQSYHSDNRWVFGGGTKLTVLGSRGGGGSGGG
GSGGGGSLEMAQVQLVESGGGLVQPGGSLRLSCAASGFTFSSYAMSWVRQAPGKGLEWV
SAISGSGGSTYYADSVKGRFTISRDNSKNTLYLQMNSLRAEDTAVYYCARSGAYWDYSVY
DEWGQGTLVTVSSTSGQAGQHHHHHHGAYPYDVPDYAS [SEQ ID NO: 672]

TABLE 117

ET200-044
DNA Sequence
cagtctgtgttgactcagccaccctcagtgtccgtgtccccaggacagacagccaccatcgcctgttctggacataaattgggggataaatatgc
ttcctggtatcagcagaagtcgggccagtcccctgtgttgatcatctatcaggataataagcggccctcagggattcctgagcgattctctggct
ccaactctgggaacacagccactctgaccatcagcgggacccaggctctggatgaggctgactattattgtcaggcgtgggacagtagtactt
atgtggcattcggcggagggaccaagctgaccgtcctaggttctagaggtggtggtggtagcggcggcggcggctctggtggtggtggatcccct
cgagatggcccaggtgcagctgcaggagtccggcccaggactggtgaagccttcggagaccctgtccctcacctgcgttgtctctggtggctc
catcagcagtagtaactggtgggagctggtccgccagccccagggaaggggctggagtggattggggaaatctatcatagtgggagcccc
aactacaacccatccctcaagagtcgagtcaccatatcagtagacaagtccaagaaccagttctccctgaagctgagctctgtgaccgccgcgg
acacggccgtgtattactgtgcgcgcatgactactcatactttcggttacgatgcttgggggtcaaggtactctggtgaccgtctcctcaacta
gtggccaggccggccagcaccatcaccatcaccatggcgcatacccgtacgacgttccggactacgcttct [SEQ ID NO: 673]

Amino Acid Sequence
QSVLTQPPSVSVSPGQTATIACSGHKLGDKYASWYQQKSGQSPVLIIYQDNKRPSGIPERFS
GSNSGNTATLTISGTQALDEADYYCQAWDSSTYVAFGGGTKLTVLGSRGGGGSGGGGSG
GGGSLEMAQVQLQESGPGLVKPSETLSLTCVVSGGSISSSNWWSWVRQPPGKGLEWIGEI
YHSGSPNYNPSLKSRVTISVDKSKNQFSLKLSSVTAADTAVYYCARMTTHTFGYDAWGQG
TLVTVSSTSGQAGQHHHHHHGAYPYDVPDYAS [SEQ ID NO: 674]

TABLE 118

ET200-045
DNA Sequence
cagcctgtgctgactcagccaccctcagtgtcagtggccccaggaaagacggccacgattacttgtgggggaaacaacattggaagtgaaagt
gtgcactggtaccaccagaagccaggccaggcccctgtgttggtcatctatgatgatgccggccggccctcagggatccctgagcgattcact
ggctccaactctgggaacacggccaccctgaccatcagcagggtcgaagccggggatgaggccgactattactgtcaggtgtgggacagaa
atagtgctcagtttgtcttcggacctgggaccaaggtcaccgtcctaggttctagaggtggtggtggtagcggcggcggcggctctggtggtgg
tggatcccctcgagatggcccgaggtccagctggtgcagtctggagctgaggtgaagaagcctggggcctcagtgaaggtctcctgcaaggcttc
tggttacacctttaccagctatggtatcagctgggtgcgacaggcccctggacaaggggcttgagtggatgggatggatcagcgcttacaatggt
aacacaaaactatgcacagaagctccagggcagagtcaccatgaccacagacacatccacgagcacagcctacatggagctgaggagcctga
gatctgacgacacggccgtgtattactgtgcgcgcggtgttcatctggattggtggggtcaaggtactctggtgaccgtctcctcaactagtgg
ccaggccggccagcaccatcaccatcaccatggcgcatacccgtacgacgttccggactacgcttct [SEQ ID NO: 675]

Amino Acid Sequence
QPVLTQPPSVSVAPGKTATITCGGNNIGSESVHWYHQKPGQAPVLVIYDDAGRPSGIPERFT
GSNSGNTATLTISRVEAGDEADYYCQVWDRNSAQFVFGPGTKVTVLGSRGGGGSGGGGS
GGGGSLEMAEVQLVQSGAEVKKPGASVKVSCKASGYTFTSYGISWVRQAPGQGLEWMG
WISAYNGNTNYAQKLQGRVTMTTDTSTSTAYMELRSLRSDDTAVYYCARGVHLDWWGQ
GTLVTVSSTSGQAGQHHHHHHGAYPYDVPDYAS [SEQ ID NO: 676]

TABLE 119

ET200-069
DNA Sequence
cagtctgtcgtgacgcagccaccctcagcgtctgggaccccgggcagagggtcaccatctcttgttctggaagcagctccaacatcggaagt
aattatgtatactggtaccagcagctcccaggaacggcccccaaactcctcatctatagtaataatcagcggccctcaggggtccctgaccgatt
ctctggctccaagtctggcacctcagcctccctggccatcagtgggctccggtccgaggatgaggctgattattactgtgcagcatgggatgac
agcctgagtggttatgtcttcggaactgggaccaagctgaccgtcctaggttctagaggtggtggtggtagcggcggcggcggctctggtggt
ggtggatccctcgagatggcccaggtgcagctacagcagtggggcgcaggactgttgaagcttcggagaccctgtccctcacctgcgctgtc
tatggtgggtccttcagtggttactactggagctggatccgccagcccccagggaaggggctggagtggattgggaaatcaatcatagtgga
agcaccaactacaacccgtccctcaagagtcgagtcaccatatcagtagacacgtccaagaaccagttctccctgaagctgagctctgtgaccg
ccgcggacacggccgtgtattactgtgcgcgcctgtacgaaggtggttaccatggttgggttcttggctgtcttctgattcttggggtcaagg
tactctggtgaccgtctcctcaactagtggccaggccggccagcaccatcaccatcaccatggcgcatacccgtacgacgttccggactacg
cttct [SEQ ID NO: 677]

Amino Acid Sequence
QSVVTQPPSASGTPGQRVTISCSGSSSNIGSNYVYWYQQLPGTAPKLLIYSNNQRPSGVPDR
FSGSKSGTSASLAISGLRSEDEADYYCAAWDDSLSGYVFGTGTKLTVLGSRGGGGSGGGG
SGGGGSLEMAQVQLQQWGAGLLKPSETLSLTCAVYGGSFSGYYWSWIRQPPGKGLEWIG
EINHSGSTNYNPSLKSRVTISVDTSKNQFSLKLSSVTAADTAVYYCARLYEGGYHGWGSW
LSSDSWGQGTLVTVSSTSGQAGQHHHHHHGAYPYDVPDYAS [SEQ ID NO: 678]

TABLE 120

ET200-078
DNA Sequence
cagtctgtgttgactcagccaccctcagcgtctgggaccccgggcagagggtcaccatctcttgttctggaagcagctccaacatcggaagta
atactgtaaactggtaccagcagctcccaggaacggcccccaaactcctcatctatagtaataatcagcggccctcaggggtccctgaccgatt
ctctggctccaagtctggcacctcagcctccctggccatcagtgggctccggtctgaggatgaggctgattattactgtgcagcatgggatgaca
gcctgaatggttattgggtgttcggcggagggaccaagctgaccgtcctaggttctagaggtggtggtggtagcggcggcggcggctctggtg
gtggtggatccctcgagatggcccaggtgcagctacagcagtggggcgcaggactgttgaagcttcggagaccctgtccctcacctgcgct
gtctatggtgggtccttcagtggttactactggagctggatccgccagcccccagggaaggggctggagtggattgggaaatcaatcatagtg
gaagcaccaactacaacccgtccctcaagagtcgagtcaccatatcagtagacacgtccaagaaccagttctccctgaagctgagctctgtgac
cgccgcggacacggctgtgtattactgtgcgcgcgaaggggcatttgatgcttttgatatctggggccaagggacaatggtcaccgtctcttcaa
ctagtggccaggccggccagcaccatcaccatcaccatggcgcatacccgtacgacgttccggactacgcttct [SEQ ID NO: 679]

Amino Acid Sequence
QSVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYWVFGGGTKLTVLGSRGGGGSGG
GGSGGGGSLEMAQVQLQQWGAGLLKPSETLSLTCAVYGGSFSGYYWSWIRQPPGKGLEW
IGEINHSGSTNYNPSLKSRVTISVDTSKNQFSLKLSSVTAADTAVYYCAREGAFDAFDIWGQ
GTMVTVSSTSGQAGQHHHHHHGAYPYDVPDYAS [SEQ ID NO: 680]

TABLE 121

ET200-079
DNA Sequence
tcctatgagctgactcagccaccctcagcgtctgggaccccgggcagagggtcaccatctcttgttctggaagcagctccaacatcggaagta
attatgtatactggtaccagcagctcccaggaacggcccccaaactcttcatctataggaataatcagcggccctcaggggtccctgaccgattc
tctggctccaagtctggcacctcagcctccctggccatcagtgggctccggtccgaggatgaggctgattattactgtgcagcatgggatgaca
gcctgagtggttatctcttcggaactgggaccaaggtcaccgtcctaggttctagaggtggtggtggtagcggcggcggcggctctggtggtg
gtggatccctcgagatggccgaggtgcagctggtggagtctgggggaggcttggtacagcctggcaggtccctgagactctcctgtgcagcct
ctggattcacctttgatgattatgccatgcactgggtccggcaagctccagggaaggggctggagtgggtctcaggtattagttggaatagtggt
agcataggctatgcggactctgtgaagggccgattcaccatctccagagacaacgccaagaactccctgtatctgcaaatgaacagtctgagag
ctgaggacacggccttgtattactgtgcaaatggcgactccaactactactacggtatggacgtctggggccaagggaccacggtcaccgtctc
ctcaactagtggccaggccggccagcaccatcaccatcaccatggcgcatacccgtacgacgttccggactacgcttct [SEQ ID NO: 681]

Amino Acid Sequence
SYELTQPPSASGTPGQRVTISCSGSSSNIGSNYVYWYQQLPGTAPKLFIYRNNQRPSGVPDR
FSGSKSGTSASLAISGLRSEDEADYYCAAWDDSLSGYLFGTGTKVTVLGSRGGGGSGGGG
SGGGGSLEMAEVQLVESGGGLVQPGRSLRLSCAASGFTFDDYAMHWVRQAPGKGLEWV
SGISWNSGSIGYADSVKGRFTISRDNAKNSLYLQMNSLRAEDTALYYCANGDSNYYYGM
DVWGQGTTVTVSSTSGQAGQHHHHHHGAYPYDVPDYAS [SEQ ID NO: 682]

TABLE 122

ET200-081
DNA Sequence
cagtctgccctgactcagcctgcctccgtgtccgggtctcctggacagtcgatcaccatctcctgcactggaaccagcagtgacattggtggtt
ataactatgtctcctggtaccaacaacacccaggcaaagccccaaactcatgatttatgatgtcagtaatcggccctcaggggtttctaatcgc
ttctctggctccaagtctggcaacacggcctccctgaccatctctgggctccaggctgaggacgaggctgattattactgcatctcatatacacg
cacctggaaccctatgtcttcggaagtgggaccaaggtcaccgtcctaggttctagaggtggtggtggtagcggcggcggcggctctggtggtg
gtggatccctcgagatggccgaggtgcagctggtgcagtctggggggaggcgtggtacagcctggggggtccctgagactctcctgtgcagcctc
tggattcacctttgatgattatgccatgcactgggtccgtcaagctccagggaagggtctggagtgggtctctcttattagtgggatggtggta
gcacatactatgcagactctgtgaagggccgattcaccatctccagagacaaaaactccctgtatctgcaaatgaacagtctgagaact
gaggacaccgccttgtattactgtgcaaaagatcgggcagcagctggctactactactacgtatggacgtctggggccaagggaccacggtca
ccgtctcctcaactagtggccaggccggccagcaccatcaccatcaccatggcgcatacccgtacgacgttccggactacgcttct [SEQ
ID NO: 683]

Amino Acid Sequence
QSALTQPASVSGSPGQSITISCTGTSSDIGGYNYVSWYQQHPGKAPKLMIYDVSNRPSGVSN
RFSGSKSGNTASLTISGLQAEDEADYYCISYTRTWNPYVFGSGTKVTVLGSRGGGGSGGG
GSGGGGGSLEMAEVQLVQSGGGVVQPGGSLRLSCAASGFTFDDYAMHWVRQAPGKGLEW
VSLISGDGGSTYYADSVKGRFTISRDNSKNSLYLQMNSLRTEDTALYYCAKDRAAAGYYY
YGMDVWGQGTTVTVSSTSGQAGQHHHHHHGAYPYDVPDYAS [SEQ ID NO: 684]

TABLE 123

ET200-097
DNA Sequence
ctgcctgtgctgactcagccaccctcagtgtccgtgtccccaggacagacagccatcatcacctgctctggagataaattgggggaaaaatatgt
ttcctggtatcagcagaagccaggccagtcccctgtactggtcatcgatcaagataccaggaggccctcagggatccctgagcgattctctggc
tccaactctgggaccacagccactctgaccatcagcgggacccaggcatatgatgaggctgactattactgtcaggcgtgggacaggggtgtg
gtattcggcggagggaccaagctgaccgtcctaggttctagaggtggtggtggtagcggcggcggcggctctggtggtggtggatccctcga
gatggccgaggtgcagctggtggagtctgggggagacttggtacagcctggcaggtcccctgagactctcctgtgcagcctctggattcacctt
taatgattatgccatgcactgggtccggcaagctccagggaagggcctggagtgggtctcaggtattagttggagtggtaataacataggctatg
cggactctgtgaagggccgattcaccatctccagagacaacgccaagaactccctgtatctgcaaatgaacagtctgagagctgaggacacgg
ccttgtattactgtgcaaaagatagtatacggtatgcatcacctggggaggttttgactactggggccagggaaccctggtcaccgtctcctc
aactagtggccaggccggccagcaccatcaccatcaccatggcgcatacccgtacgacgttccggactacgcttct [SEQ ID NO: 685]

Amino Acid Sequence
LPVLTQPPSVSVSPGQTAIITCSGDKLGEKYVSWYQQKPGQSPVLVIDQDTRRPSGIPERFSG
SNSGTTATLTISGTQAMDEADYYCQAWDRGVVFGGGTKLTVLGSRGGGGSGGGGSGGG
GSLEMAEVQLVESGGDLVQPGRSLRLSCAASGFTFNDYAMHWVRQAPGKGLEWVSGISW
SGNNIGYADSVKGRFTISRDNAKNSLYLQMNSLRAEDTALYYCAKDSIRYGITWGGFDYW
GQGTLVTVSSTSGQAGQHHHHHHGAYPYDVPDYAS [SEQ ID NO: 686]

TABLE 124

ET200-098
DNA Sequence
cagcctgtgctgactcagccaccctcggtgtccaagggcttgagacagaccgccacactcacctgcactgggaacagcaacaatgttggcaa
cctaggagtagcttggctgcagcagcaccagggccacctccccaaactcctatcctacaggaataacaaccggccctcagggatctcagaga
gattatctgcatccaggtcaggaaacacagcctcccctgaccattactggactccagcctgaggacgaggctgactattactgctcagcatggga
cagtagcctcagtgcttgggtgttcggcggagggaccaagctgaccgtcctaggttctagaggtggtggtggtagcggcggcggcggctctg
gtggtggtggatccctcgagatggccgaggtgcagctggtggagtctggggggagtcgtggtacagcctgggggggtccctgagactctcctgt
gcagcctctggattcacctttgatgattatgccatgcactgggtccgtcaagctccggggaagggtctggagtgggtctctcttattaattggga
tggtggtagcacctactatgcagactctgtgaagggtcgattcaccatctccagagacaacagcaaaaactccctgtatctgcaaatgaacagtc
tgagagctgaggacaccgccttgtattactgtgcaaaagggatgggcctgagggcgtttgactactggggccagggaaccctggtcaccgtctc
ctcaactagtggccaggccggccagcaccatcaccatcaccatggcgcatacccgtacgacgttccggactacgcttct [SEQ ID NO:
687]

Amino Acid Sequence
QPVLTQPPSVSKGLRQTATLTCTGNSNNVGNLGVAWLQQHQGHPPKLLSYRNNNRPSGIS
ERLSASRSGNTASLTITGLQPEDEADYYCSAWDSSLSAWVFGGGTKLTVLGSRGGGGSGG
GGSGGGGSLEMAEVQLVESGGVVVQPGGSLRLSCAASGFTFDDYAMHWVRQAPGKGLE
WVSLINWDGGSTYYADSVKGRFTISRDNSKNSLYLQMNSLRAEDTALYYCAKGMGLRAF
DYWGQGTLVTVSSTSGQAGQHHHHHHGAYPYDVPDYAS [SEQ ID NO: 688]

TABLE 125

ET200-099
DNA Sequence
cagtctgtgttgactcagccaccctcagcgtctggggaccccccgggcagagggtcaccatctcctgttctggaagcagctccaacatcggaagta
atactgtaaactggtaccagcagctcccaggaacggcccccaaactcctcatctatagtaatgatcagcggccctcaggggtccctgaccgatt
ctctggctccaagtccggcacctcagcctccctggccatcagtgggctccagtctgaggatgaggctgattattactgtgcttcatgggatgaca
gcctgaatggccgttatgtcttcggaactgggaccaaggtcaccgtcctaggttctagaggtggtggtggtagcggcggcggcggctctggtg
gtggtggatccctcgagatggcccaggtccagctggtacagtctggggctgaggtgaggaagcctggggcctcagtgaaggtttcctgcaag
acttctggatacaccttcagttggtatgctatacattgggtgcgccaggcccccggacaaaggcttgagtggatgggatggatcaacgctggca
atggaaacacaaaatattcacagaaatttcagggcagagtcacttaccagggacacatccgcgagcacagcctacatggagctgagcagcc
tgagatctgatgacacggctgtgtattactgtgcgagacccgataatatatggttcggggtggggatgttttgatatctggggccaaggggacaatg
gtcaccgtctcttcaactagtggccaggccggccagcaccatcaccatcaccatggcgcatacccgtacgacgttccggactacgcttct [SEQ
ID NO: 689]

Amino Acid Sequence
QSVLTQPPSASGTPGQRVTISCSGSSSNIGSNTVNWYQQLPGTAPKLLIYSNDQRPSGVPDR
FSGSKSGTSASLAISGLQSEDEADYYCASWDDSLNGRYVFGTGTKVTVLGSRGGGGSGGG
GSGGGGGSLEMAQVQLVQSGAEVRKPGASVKVSCKTSGYTFSWYAIHWVRQAPGQRLEW
MGWINAGNGNTKYSQKFQGRVSLTRDTSASTAYMELSSLRSDDTAVYYCARPDNYGSGG
DVFDIWGQGTMVTVSSTSGQAGQHHHHHHGAYPYDVPDYAS [SEQ ID NO: 690]

TABLE 126

ET200-100
DNA Sequence
aattttatgctgactcagccccactctgtgtcggagtctccggggaagacggtaaccatctcctgcacccgcagcagtggcagcattgccagca
actttgtgcagtggtaccagcagcgcccgggcagtgccccaccccctatgatctatgaggataacaacagaccccctggggtccctgatcggtt
ctctgcctccgtcgacagctcctccaactctgcctccctcaccatctctggactgaagactgaggacgaggctgactactactgtcagtcttatg
ataccagcaatgtggtattcggcggggggaccaagctgaccgtcctaggttctagaggtggtggtggtagcggcggcggcggctctggtggtgg
tggatccctcgagatggccgaggtgcagctggtggagtctggggggaggcttggtacagcctggagggtccctgagactctcctgtgcagcctc
tggattcacctttagtagttatgaaatgaactgggtccgccaggctccagggaaggggctggagtgggtttcatacattagtagtagtggtagta
ccatatactacgcagactctgtgaagggccgattcaccatctccagagacaacgccaagaactcactgtatctgcaaatgaacagcctgagagcc
gaggacacggctgtttattactgtgcacgctgggactacggtatggacgtctggggccaagggaccacggtcaccgtctcctcaactagtggc
caggccggccagcaccatcaccatcaccatggcgcatacccgtacgacgttccggactacgcttct [SEQ ID NO: 691]

Amino Acid Sequence
NFMLTQPHSVSESPGKTVTISCTRSSGSIASNFVQWYQQRPGSAPTPMIYEDNNRPPGVPDR
FSASVDSSSNSASLTISGLKTEDEADYYCQSYDTSNVVFGGGTKLTVLGSRGGGGSGGGGS
GGGGSLEMAEVQLVESGGGLVQPGGSLRLSCAASGFTFSSYEMNWVRQAPGKGLEWVSY
ISSSGSTIYYADSVKGRFTISRDNAKNSLYLQMNSLRAEDTAVYYCARWDYGMDVWGQG
TTVTVSSTSGQAGQHHHHHHGAYPYDVPDYAS [SEQ ID NO: 692]

TABLE 127

ET200-101
DNA Sequence
caggctgtgctgactcagccaccctcagcgtctggggcccccgggcagagggtcaccgtctcttgttctggaagcaactccaacatcggaagt
aactacgttaactggtaccagcagttcccaggaacgcccccaaactcctcatgtatagtagtagtcagcggccctcaggggtccctgaccgat
tctctggctccaagtctggcacctcagcctccctggccatcagtgggctccactctgaggatgaggctgattattactgtgctacatgggatgac
agcctgaatgcttgggtgttcggcggagggaccaagctgaccgtcctaggttctagaggtggtggtggtagcggcggcggcggctctggtggt
ggtggatccctcgagatggccgaggtccagctggtgcagtctggggctgaggtgaggaagcctggggcctcagtgaaggtttcctgcaagac
ttctggatacaccttcacttggtatgctatacattgggtgcgccaggcccccggacaaaggcttgagtggatgggatggatcaacgctggcagtg
gaaacacaaaatattcacagaaatttcagggcagagtcacccttaccagggacacatccgcgagcacagcgtacatggagctgagcagcctg
agatctgatgacacggctgtgtattactgtgcgagacccaataactatggttcggggtggggatgttttgatatctggggccaagggacaatggt
caccgtctcttcaactagtggccaggccggccagcaccatcaccatcaccatggcgcatacccgtacgacgttccggactacgcttct [SEQ
ID NO: 693]

Amino Acid Sequence
QAVLTQPPSASGAPGQRVTVSCSGSNSNIGSNYVNWYQQFPGTAPKLLMYSSSQRPSGVP
DRFSGSKSGTSASLAISGLHSEDEADYYCATWDDSLNAWVFGGGTKLTVLGSRGGGGSGG
GGSGGGGSLEMAEVQLVQSGAEVRKPGASVKVSCKTSGYTFTWYAIHWVRQAPGQRLE
WMGWINAGSGNTKYSQKFQGRVTLTRDTSASTAYMELSSLRSDDTAVYYCARPNNYGSG
GDVFDIWGQGTMVTVSSTSGQAGQHHHHHHGAYPYDVPDYAS [SEQ ID NO: 694]

TABLE 128

ET200-102
DNA Sequence
cagtctgtcgtgacgcagccgccctcagtgtctgcggccccaggacagaaggtcaccatctcctgctctggaagcagctccaacattgggaat
aattatgtatcctggtaccagcagctcccaggaacagccccaaactcctcatttatgacaataataagcgaccctcagggattcctgaccgatt
ctctggctccaagtctggcacgtcagccaccctgggcatcaccggactccagactggggacgaggccgattattactgcggaacatgggatagc
agcctgagtgcttatgtcttcggaactgggaccaaggtcaccgtcctaggttctagaggtggtggtggtagcggcggcggcggctctggtggtg
gtggatccctcgagatggcccaggtccagctggtgcagtctggggctgaggtgaagaagcctggggcctcagtgaaagtttcctgcaaggctt
ctggatacaccttcacgaactatgctctgcattgggtgcgccaggcccccggacaagggcttgagtggatggcatggatcaacggtggcaatg
gtaacacaaaatattcacagaacttccagggcagagtcaccattaccagggacacatccgcgagcacagcctatatggagctgagcagcctga
gatctgaagacacggctgtgtattactgtgcgaaaccggaggaaacagctggaacaatccactttgactactgggccagggaaccccggtca
ccgtctcctcaactagtggccaggccggccagcaccatcaccatcaccatggcgcatacccgtacgacgttccggactacgcttct [SEQ
ID NO: 695]

Amino Acid Sequence
QSVVTQPPSVSAAPGQKVTISCSGSSSNIGNNYVSWYQQLPGTAPKLLIYDNNKRPSGIPDR
FSGSKSGTSATLGITGLQTGDEADYYCGTWDSSLSAYVFGTGTKVTVLGSRGGGGSGGGG
SGGGGSLEMAQVQLVQSGAEVKKPGASVKVSCKASGYTFTNYALHWVRQAPGQGLEW
MAWINGGNGNTKYSQNFQGRVTITRDTSASTAYMELSSLRSEDTAVYYCAKPEETAGTIH
FDYWGQGTPVTVSSTSGQAGQHHHHHHGAYPYDVPDYAS [SEQ ID NO: 696]

TABLE 129

ET200-103
DNA Sequence
caggctgtgctgactcagccccactctgtgtcggagtctccggggaagacggtaaccatctcctgcacccgcagcagtggcagcattgccagc
aactatgtgcagtggtaccagcagcgcccgggcagtgcccccaccactgtgatctatgaggataaccaaagaccctctggggtccctgatcgg
ttctctggctccatcgacagctcctccaactctgcctccctcaccatctctggactgaagactgaggacgaggctgactactactgtcagtctta
tgatagcaccatcacggtgttcggcggagggaccaaggctgaccgtcctaggtctagaggtggtggtggtagcggcggcggcggctctggtggt
ggtggatccctcgagatggcccaggtccagctggtacagtctggggctgaggtgaagaagcctgggtcctcggtgaaggtctcctgcaaggc
ttctggaggcaccttcagcagctatgctatcagctgggtgcgacaggcccctggacaagggcttgagtggatgggagggatcatccctatcttt
ggtacagcaaactacgcacagaagttccagggcagagtcacgattaccgcggacgaatccacgagcacagcctacatggagctgagcagcc
tgagatctgaggacacggccgtgtattactgtgcggggagggttactatgatagtagtggttattccaacggtgatgcttttgatatctgggc
caagggacaatggtcaccgtctcttcaactagtggccaggccggccagcaccatcaccatcaccatggcgcatacccgtacgacgttccggact
acgcttct [SEQ ID NO: 697]

Amino Acid Sequence
QAVLTQPHSVSESPGKTVTISCTRSSGSIASNYVQWYQRPGSAPTTVIYEDNQRPSGVPDR
FSGSIDSSSNSASLTISGLKTEDEADYYCQSYDSTITVFGGGTKLTVLGSRGGGGSGGGGSG
GGGSLEMAQVQLVQSGAEVKKPGSSVKVSCKASGGTFSSYAISWVRQAPGQGLEWMGGI
IPIFGTANYAQKFQGRVTITADESTSTAYMELSSLRSEDTAVYYCAGEGYYDSSGYSNGDA
FDIWGQGTMVTVSSTSGQAGQHHHHHHGAYPYDVPDYAS [SEQ ID NO: 698]

TABLE 130

ET200-104
DNA Sequence
aattttatgctgactcagccccactctgtgtcggagtctccggggaagacggtaaccatctcctgcacccgcagcagtggcagcattgccagca
actatgtgcagtggtaccagcagcgcccgggcagtgcccccaccactgtgatctatgaggataaccaaagaccctctggggtccctgatcggtt
ctctggctccatcgacagctcctccaactctgcctccctcaccatctctggactgaagactgaggacgaggctgactactactgtcagtcttatg
atagcagcaatgtggtattcggcggagggaccaaggtcaccgtcctaggttctagaggtggtggtggtagcggcggcggcggctctggtggtgg
tggatccctcgagatggccgaggtgcagctggtggagtctgggggaggcttggtacagcctggagggtccctgagactcctctgtgcagcctc
tggattcaccttcagtagttatgaaatgaactgggtccgccaggctccaggaaggggctggagtgggtttcatacattagtagtagtggtagta
ccatatactacgcagactctgtgaagggccgattcaccatctccagagacaacgccaagaactcactgtatctgcaaatgaacagcctgagacc
gaggacacggctgtttattactgtgcacgctgggactacggtatggacgtctggggccaagggaccacggtcaccgtctcctcaactagtggc
caggccggccagcaccatcaccatcaccatggcgcatacccgtacgacgttccggactacgcttct [SEQ ID NO: 699]

Amino Acid Sequence
NFMLTQPHSVSESPGKTVTISCTRSSGSIASNYVQWYQQRPGSAPTTVIYEDNQRPSGVPDR
FSGSIDSSSNSASLTISGLKTEDEADYYCQSYDSSNVVFGGGTKVTVLGSRGGGGSGGGGS
GGGGSLEMAEVQLVESGGGLVQPGGSLRLSCAASGFTFSSYEMNWVRQAPGKGLEWVSY
ISSSGSTIYYADSVKGRFTISRDNAKNSLYLQMNSLRAEDTAVYYCARWDYGMDVWGQG
TTVTVSSTSGQAGQHHHHHHGAYPYDVPDYAS [SEQ ID NO: 700]

TABLE 131

ET200-105
DNA Sequence
tcctatgtgctgactcagccaccctcagtgtccgtgtccccaggacagacagccagcatcacctgctctggagatagattgacgaataaatatgt
ttcctggtatcaacagaagccaggccagtcccctgtgttggtcatctatgaggatgccaagcggccctcagggatccctgcgcgattctctggct
ccaactctgggaacacagccactctgaccatcagcgggacccaggctatggatgagtctgaatattactgtcaggcgtgggacagcagtgtggt
ggttttggcggagggaccaagctgaccgtcctaggttctagaggtggtggtggtagcggcggcggcggctctggtggtggtggatccctcga
gatggccgaggtgcagctggtggagtctgggggaggcttggtacagcctggcaggtccctgagactctcctgtgcagcctctggatttacctt
gatgattatgccatgcactgggtccggcaagctccagggaagggcctggagtgggtctcaggtattagttggaatagtggtagtataggctatg
cggactctgtgaaggggcgattcaccatctccagagacaacgccaagaactccctgtatctgcaaatgaacagtctgagagatgaggacacgg
ccttgtattactgtgcaaaagaccgaggggggggagttatcgttaaggatgcttttgatatctggggccaagggacaatggtcaccgtctcttca
actagtggccaggccgccagcaccatcaccatcaccatggcgcataccgtacgacgttccggactacgcttct [SEQ ID NO: 701]

Amino Acid Sequence
SYVLTQPPSVSVSPGQTASITCSGDRLTNKYVSWYQQKPGQSPVLVIYEDAKRPSGIPARFS
GSNSGNTATLTISGTQAMDESEYYCQAWDSSVVFGGGTKLTVLGSRGGGGSGGGGSGG
GGSLEMAEVQLVESGGGLVQPGRSLRLSCAASGFTFDDYAMHWVRQAPGKGLEWVSGIS
WNSGSIGYADSVKGRFTISRDNAKNSLYLQMNSLRDEDTALYYCAKDRGGVIVKDAFDI
WGQGTMVTVSSTSGQAGQHHHHHHGAYPYDVPDYAS [SEQ ID NO: 702]

TABLE 132

ET200-106
DNA Sequence
tcctatgagctgactcagccacccgcagcgtctgggaccccggacagagagtcaccatctcttgttctgggggcgtctccaacatcgggagt
ggtgctctaaattggtaccagcaactcccaggaacggcccccaaactcctcatctatagttacaatcagcggccctcaggggtctctgaccgatt
ctctggctccagtctgccacctcagcctccctggccatcagtggcctccaggctgaggatgaggctgattattactgtgcaacctgggatgata
gtgtgaatggttgggtgttcggcggagggaccaagctgaccgtcctaggttctagaggtggtggtggtagcggcggcggcggctctggtggt
ggtggatccctcgagatggccgaggtgcagctggtggagtctggagctgaggtgaagaagcctggggattcagtgaaggtctcctgcaagcc
ttctggttacaattttctcaactatggtatcaactgggtgcgacaggcccctggacaagggcttgagtggatgggatggattagcacttacaccg
gtaacacaaactatgcacagaagctgcagggcagagtcaccttcaccacagacacatccacgagcacagcctacatggagatgaggagcctga
gatctgacgacacggccgtgtattactgtgcgcgccagcagggtggtggtacgatgtttggggtcaaggtactctggtcaccgtctcctca
actagtggccaggccgccagcaccatcaccatcaccatggcgcataccgtacgacgttccggactacgcttct [SEQ ID NO: 703]

Amino Acid Sequence
SYELTQPPAASGTPGQRVTISCSGGVSNIGSGALNWYQQLPGTAPKLLIYSYNQRPSGVSDR
FSGSRSATSASLAISGLQSEDEADYYCATWDDSVNGWVFGGGTKLTVLGSRGGGGSGGG
GSGGGGSLEMAEVQLVESGAEVKKPGDSVKVSCKPSGYNFLNYGINWVRQAPGQGLEW
MGWISTYTGNTNYAQKLQGRVTFTTDTSTSTAYMEMRSLRSDDTAVYYCARQQGGGWY
DVWGQGTLVTVSSTSGQAGQHHHHHHGAYPYDVPDYAS [SEQ ID NO: 704]

TABLE 133

ET200-107
DNA Sequence
cagtctgtcgtgacgcagccgccctcagtgtctgcggccccaggagagaaggtcaccatctcctgctctggaagcaacttcaatgttggaaata
atgatgtatcctggtatcagcaactcccaggtgcagcccccaaactcctcatttatgacaataataagcgaccctcagggattcctgaccgattc
tctggctccaagtctggcacgtcagccaccctggacatcaccgggctccacagtgacgacgaggccgattattactgcggaacatgggatagca
gcctgaatactggggggtcttcggaactgggaccaaggtcaccgtcctaggttctagaggtggtggtggtagcggcggcggcggctctggt
ggtggtggatccctcgagatggccgaggtccagctggtgcagtctggagctgaggtgaagaagcctggggcctcagtgaaggtctcctgcaa
ggcttctggttacacctttaccagctatactatcagctgggtacgacaggcccctggacaagggcttgagtggatgggatggatcagcacttaca
atggtctcacaaactatgcacagaacctccagggcagagtcaccatgactacagacacattcacgaccacagcctacatggagctgaggagc
ctcagatctgacgacacggccgtgtattactgtgtgagagagggtcccccgactacggtgacttcgcgtcctttgactactggggccaggaa
ccctggtcaccgtctcctcaactagtggccaggccgccagcaccatcaccatcaccatggcgcataccgtacgacgttccggactacgcttc
t [SEQ ID NO: 705]

Amino Acid Sequence
QSVVTQPPSVSAAPGEKVTISCSGSNFNVGNNDVSWYQQLPGAAPKLLIYDNNKRPSGIPD
RFSGSKSGTSATLDITGLHSDDEADYYCGTWDSSLNTGGVFGTGTKVTVLGSRGGGGSGG
GGSGGGGSLEMAEVQLVQSGAEVKKPGASVKVSCKASGYTFTSYTISWVRQAPGQGLEW
MGWISTYNGLTNYAQNLQGRVTMTTDTFTTTAYMELRSLRSDDTAVYYCVREGSPDYGD
FASFDYWGQGTLVTVSSTSGQAGQHHHHHHGAYPYDVPDYAS [SEQ ID NO: 706]

TABLE 134

ET200-108
DNA Sequence
cagtctgtgttgacgcagccgccctcagtgtctgcgccccgggacagaaggtcaccatctcctgctctggaagcagctccaacattgggaata
attatgtatcctggtaccagcagttcccaggaacagcccccaaactcctcatttatgacaataataagcgaccctcagggatttctgaccgattc
tctggctccaagtctggcacgtcagccaccctgggcatcgccggactccagactggggacgaggccgattattactgcggaacatgggatacca
gcctgagtggttttttatgtcttcggaagtgggaccaaggtcaccgtcctaggttctagaggtggtggtggtagcggcggcggcggctctggtggt
ggtgatccctcgagatggccgaggtccagctggtacagtctggagctgaggtgaagaagcctggggcctcagtgaaggtctcctgcaaggc
ttctggttacacctttaccagctatactatcagctgggtacgacaggcccctggacaagggcttgagtggatgggatggatcagcacttacaatg
gtctcacaaactatgcacagaacctccagggcagagtcaccatgactacagacacattcacgaccacagccctacatggagctgaggagcctca
gatctgacgacacggccgtgtattactgtgtgagagaggggtccccgactacggtgacttcgcgtcctttgactactggggccagggaaccct
ggtcaccgtctcctcaactagtggccaggccggccagcaccatcaccatcaccatggcgcatacccgtacgacgttccggactacgcttct
[SEQ ID NO: 707]

Amino Acid Sequence
QSVLTQPPSVSAPPGQKVTISCSGSSSNIGNNYVSWYQQFPGTAPKLLIYDNNKRPSGISDRF
SGSKSGTSATLGIAGLQTGDEADYYCGTWDTSLSGFYVFGSGTKVTVLGSRGGGGSGGGG
SGGGGSLEMAEVQLVQSGAEVKKPGASVKVSCKASGYTFTSYTISWVRQAPGQGLEWMG
WISTYNGLTNYAQNLQGRVTMTTDTFTTTAYMELRSLRSDDTAVYYCVREGSPDYGDFA
SFDYWGQGTLVTVSSTSGQAGQHHHHHHGAYPYDVPDYAS [SEQ ID NO: 708]

TABLE 135

ET200-109
DNA Sequence
ctgcctgtgctgactcagccaccctcagcgtctgcgaccccgggcagagggtcaccatctcttgttctggaaccacctccaacatcggaagta
atactgtacactggtaccagcagctcccagggacggcccccaaactcctcatctataataataatcagcggccctcaggggtccctgaccgatt
ctctggctccaagtctggcacctcagcctccctggccatcagtgggctccagaggatgaggctacatattcctgtgcaacatgggatgac
agcctgagtggtggtcttcggcggagggaccaagctgaccgtcctaggttctagaggtggtggtggtagcggcggcggcggctctggtgg
tggtggatccctcgagatggccgaggtccagctggtgcagtctggggctgaggtgaagaagcctggggcctcggtgaaggtctcctgcaagg
cttctggaggcaccttcagcagctatgctatcagctgggtgcgacaggcccctggacaagggcttgagtggatgggagggatcatccctatcttt
ggtacagcaaactacgcacagaagttccagggcagagtcacgattaccgcggacgaatccacgagcacagcctacatggagctgagcagcc
tgagatctgaggacacggccgtgtattactgtgcgagagatcccgcctacggtgactacgagtatgatgcttttgatatctggggccaagggaca
atggtcaccgtctcttcaactagtggccaggccggccagcaccatcaccatcaccatggcgcatacccgtacgacgttccggactacgcttct
[SEQ ID NO: 709]

Amino Acid Sequence
LPVLTQPPSASATPGQRVTISCSGTTSNIGSNTVHWYQQLPGTAPKLLIYNNNQRPSGVPDR
FSGSKSGTSASLAISGLRSEDEATYSCATWDDSLSGVVFGGGTKLTVLGSRGGGGSGGGGS
GGGGSLEMAEVQLVQSGAEVKKPGSSVKVSCKASGGTFSSYAISWVRQAPGQGLEWMGG
IIPIFGTANYAQKFQGRVTITADESTSTAYMELSSLRSEDTAVYYCARDPAYGDYEYDAFDI
WGQGTMVTVSSTSGQAGQHHHHHHGAYPYDVPDYAS [SEQ ID NO: 710]

TABLE 136

ET200-110
DNA Sequence
cagtctgtgttgacgcagccgccctcagcgtctgggaccccgggcagagggtcaccatctcttgttctggaagcagctccaacatcggaacta
atggtgtaaactggttccagcagttcccaggaacggcccccaaactcctcatctatactaatgatcagcggccctcaggggtccctgaccgattc
tctggctccaagtctggcacctcagcctccctggccatcagtgggctccagtctgcggatgaggctgattattactgtgcagtgtgggaccacag
cctgaatggtccggtgttcggcggagggaccaagctgaccgtcctaggttctagaggtggtggtggtagcggcggcggcggctctggtggtg
gtggatccctcgagatggcccaggtgcagctggtgcagtctggggctgaggtgaagaagcctgggtcctcggtgaaggtctcctgcaaggctt
ctggaggcaccttcagcagctatgctatcagctgggtgcgacaggcccctggacaagggcttgagtggatgggagggatcatccctatctttgg
tacagcaaactacgcacagaagttccagggcagagtcacgattaccgcggacgaatccacgagcacagcctacatggagctgagcagcctg
agatctgaggacacggccgtgtattactgtgcgagaggggccggttttgatgcttttgatatctggggccaagggacaatggtcaccgtctcttc
aactagtggccaggccggccagcaccatcaccatcaccatggcgcatacccgtacgacgttccggactacgcttct [SEQ ID NO: 711]

Amino Acid Sequence
QSVLTQPPSASGTPGQRVTISCSGSSSNIGTNGVNWFQQFPGTAPKLLIYTNDQRPSGVPDR
FSGSKSGTSASLAISGLQSADEADYYCAVWDHSLNGPVFGGGTKLTVLGSRGGGGSGGGG
SGGGGSLEMAQVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARGAGFDAFDIWGQ
GTMVTVSSTSGQAGQHHHHHHGAYPYDVPDYAS [SEQ ID NO: 712]

TABLE 137

ET200-111
DNA Sequence
caggctgtgctgactcagccaccctcagcgtctgggaccccgggcagagggtcaccatctcttgttctggaagcagctccaacatcggaagt
aatactgtaaactggtaccagcagctcccaggaacggcccccaaactcctcatctatagtaataatcagcggccctcaggggtccctgaccgat
tctctggctccaagtctggcacctcagcctccctggccatcagtgggctccagtctgaggatgagactgattattactgtgcagcatgggatgac
agcctgaatggttatgtcttcggaactgggaccaaggtcaccgtcctaggttctagaggtggtggtggtagcggcggcggcggctctggtggtg
gtggatccctcgagatggcccaggtgcagctacagcagtggggcgcaggactgttgaagccttcggagaccctgtcctcacctgcgctgtct
atggtgggtccttcagtggttactactggagctggatccgccagcccccagggaaggggctggagtggattgggaaatcaatcatagtggaa
gcaccaactacaacccgtccctcaagagtcgagtcaccatatcagtagacacgtccaagaaccagttctccctgaagctgagctctgtgaccgc
cgcggacacggctgtgtattactgtgcgagagaggggctagatgcttttgatatctggggccaagggacaatggtcaccgtctcttcaactagtg
gccaggccggccagcaccatcaccatcaccatggcgcatacccgtacgacgttccggactacgcttct [SEQ ID NO: 713]

Amino Acid Sequence
QAVLTQPPSASGTPGQRVTISCSGSSSNIGSNTVNWYQQLPGTAPKLLIYSNNQRPSGVPDR
FSGSKSGTSASLAISGLQSEDETDYYCAAWDDSLNGYVFGTGTKVTVLSRGGGGSGGGG
SGGGGSLEMAQVQLQQWGAGLLKPSETLSLTCAVYGGSFSGYYWSWIRQPPGKGLEWIG
EINHSGSTNYNPSLKSRVTISVDTSKNQFSLKLSSVTAADTAVYYCAREGLDAFDIWGQGT
MVTVSSTSGQAGQHHHHHHGAYPYDVPDYAS [SEQ ID NO: 714]

TABLE 138

ET200-112
DNA Sequence
caggctgtgctgactcagccaccctcagcgtctgggaccccgggcagagggtcaccatctcttgttctggaagcagctccaacatcggaagt
aatactgtaaactggtaccagcagctcccaggaacggcccccaaactcctcatgtatagtaatgatcagcggccctcaggggtccctgaccgat
tctctggctccaagtctggcacctcagcctccctggccatcagtgggctccagtctgaggatgaggctgattattattgtgcagcatgggatgac
agcctgaatggttatgtcttcgcagctgggacccagtctaccgttttaagttctagaggtggtggtggtagcggcggcggcggctctggtggtgg
tggatccctcgagatggcccaggtgcagctacagcagtggggcgcaggactgttgaagccttcggagaccctgtcctcacctgcgctgtctat
ggtgggtccttcagtggttactactggagctggatccgccagcccccagggaaggggctggagtggattgggaaatcaatcatagtggaag
caccaactacaacccgtccctcaagagtcgagtcaccatatcagtagacacgtccaagaaccagttctccctgaagctgagctctgtgaccgcc
gcggacacggctgtgtattactgtgcgagagaggggctagatgcttttgatatctggggccaagggacaatggtcaccgtctcttcaactagtgg
ccaggccggccagcaccatcaccatcaccatggcgcatacccgtacgacgttccggactacgcttct [SEQ ID NO: 715]

Amino Acid Sequence
QAVLTQPPSASGTPGQRVTISCSGSSSNIGSNTVNWYQQLPGTAPKLLMYSNDQRPSGVPD
RFSGSKSGTSASLAISGLQSEDEADYYCAAWDDSLNGYVFAAGTQLTVLSSRGGGGSGGG
GSGGGGSLEMAQVQLQQWGAGLLKPSETLSLTCAVYGGSFSGYYWSWIRQPPGKGLEWI
GEINHSGSTNYNPSLKSRVTISVDTSKNQFSLKLSSVTAADTAVYYCAREGLDAFDIWGQG
TMVTVSSTSGQAGQHHHHHHGAYPYDVPDYAS [SEQ ID NO: 716]

TABLE 139

ET200-113
DNA Sequence
cagtctgtcgtgacgcagccgccctcagtgtctgcggccccaggacagaaggtcaccatctcctgctctggaagcagctccaacattgggaat
aattatgtatcctggtaccagcagctcccaggaacagcccccaaactcctcatttatgacaataataagcgaccctcagggattcctgaccgatt
ctctggctccaagtctggcacgtcagccaccctgggcatcactggactcagactggggacgaggccgattattactgcggaacatgggatagc
agcctgagtgctgcttatgtcttcggaactgggaccaaggtcaccgtcctaggttctagaggtggtggtggtagcggcggcggcggctctggtg
gtggtggatccctcgagatggcccaggtccagctggtacagtctggagctgaggtgaagaagcctggggcctcagtgaaggtctcctgcaag
gcttctggttacagctttaccagctatactatcagctgggttcgacaggcccctggacaaggccttgagtggatgggatgggtcagcacttacaa
tggtctcagaaactatgcacagaacctccagggcagagtcaccatgactacagacacactcacgaccacagcctacatggagctgaggagcct
cagatctgacgacacggccgtgtattattgtgtgagagaggggtcccccgactacggtgacttcgcggccttttgactactggggccagggcac
cctggtcaccgtctcctcaactagtggccaggccggccagcaccatcaccatcaccatggcgcatacccgtacgacgttccggactacgcttct
[SEQ ID NO: 717]

Amino Acid Sequence
QSVVTQPPSVSAAPGQKVTISCSGSSSNIGNNYVSWYQQLPGTAPKLLIYDNNKRPSGIPDR
FSGSKSGTSATLGITGLQTGDEADYYCGTWDSSLSAAYVFGTGTKVTVLSRGGGGSGGGG
SGGGGSLEMAQVQLVQSGAEVKKPGASVKVSCKASGYSFTSYTISWVRQAPGQGLEWM
GWVSTYNGLRNYAQNLQGRVTMTTDTLTTAYMELRSLRSDDTAVYYCVREGSPDYGD
FAAFDYWGQGTLVTVSSTSGQAGQHHHHHHGAYPYDVPDYAS [SEQ ID NO: 718]

TABLE 140

ET200-114
DNA Sequence
caggctgtgctgactcagccaccctcagcgtctgagaccccggcagagggtcaccatctcttgttctggaagcaggtccaacatcggaact
aatattgtacactggtaccagcagcgcccaggaatggcccaaactcctcacttatggtagtcggcggcctcaggggtcccggaccgattct
ctggctccaagtttggcacctcagcctccctggccatcagtgggctccagtctgaggatgaggctgattattattgtgcagcatgggatgacagt
ctgaatggtccggctttcggcggagggaccaagctgaccgtcctaggttctagaggtggtggtggtagcggcggcggcggctctggtggtggt
ggatccctcgagatggcccaggtgcagctacagcagtggggcgcaggactgttgaagccttcggagaccctgtccctcacctgcgctgtctat
ggtgggtccttcagtggttactactggagctggatccgccagcccccagggaaggggctggagtggattgggaaatcaatcatagtggaag
caccaactacaacccgtccctcaagagtcgagtcaccatatcagtagacacgtccaagaaccagttctcccctgaagctgagctctgtgaccgcc
gcggacacggctgtgtattactgtgcgagagacggtgggggctactttgactactggggccagggaaccctggtcaccgtctcctcaactagtg
gccaggccggccagcaccatcaccatcaccatggcgcatacccgtacgacgttccggactacgcttct [SEQ ID NO: 719]

Amino Acid Sequence
QAVLTQPPSASETPGQRVTISCSGSRSNIGTNIVHWYQQRPGMAPKLLTYGSRRPSGVPDRF
SGSKFGTSASLAISGLQSEDEADYYCAAWDDSLNGPAFGGGTKLTVLGSRGGGGSGGGGS
GGGGSLEMAQVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCARDGGGYFDYWGQGTL
VTVSSTSGQAGQHHHHHGAYPYDVPDYAS [SEQ ID NO: 720]

TABLE 141

ET200-115
DNA Sequence
cagtctgtgttgacgcagccgccctcagtgtctggggcccccagggcagagggtcaccatctcctgcactgggagcagctccaatatcggggc
acgttatgatgtacactggtaccagcaactcccaggaacagcccccgactcctcatctctgctaactacgatcggccctcaggggtccctgac
cgattctctggctccaagtctggcacctcagcctccctggccaccccaggttccaggctgaggatgaggctgattattactgccagtcctatga
cagcagtgtgagtgcttgggtgttcggcggagggaccaaggtcaccgtcctaggttctagaggtggtggtggtagcggcggcggcggctctg
tggtggtggatccctcgagatggccgaagtgcagctggtgcagtctggggctgaagtgaaggagcctggggcctcagtgaggatctcctgcc
aggcatctggatacaacttcatcagttattatatgcactgggcggcaggccctggcaaggtcttgagtggatgggcaccatcaacccagg
cagtggtgagacagactactcacagaagttgcagggcagagtcaccatgaccagggacccgtccacgggtacattcgacatggggctgagc
agcctgacatctggggacacggccgtctattattgtgcgacaggtctcatcagaggagctagcgatgcttttaatatctggggccgggggacaat
ggtcaccgtctcttcaactagtggccaggccggccagcaccatcaccatcaccatggcgcatacccgtacgacgttccggactacgcttct
[SEQ ID NO: 721]

Amino Acid Sequence
QSVLTQPPSVSGAPGQRVTISCTGSSSNIGARYDVHWYQQLPGTAPRLLISANYDRPSGVPD
RFSGSKSGTSASLAITGLQAEDEADYYCQSYDSSVSAWVFGGGTKVTVLGSRGGGGSGGG
GSGGGGSLEMAEVQLVQSGAEVKEPGASVRISCQASGYNFISYYMHWVRQAPGQGLEW
MGTINPGSGETDYSQKLQGRVTMTRDPSTGTFDMGLSSLTSGDTAVYYCATGLIRGASDA
FNIWGRGTMVTVSSTSGQAGQHHHHHGAYPYDVPDYAS [SEQ ID NO: 722]

TABLE 142

ET200-116
DNA Sequence
cagcctgtgctgactcagccaccctcagtgtccgtgtccccaggacagacggccgccatccctgttctggagataagttgggggataaatttg
cttcctggtatcagcagaagccaggccagtccccctgtgctggtcatctatcaagatactaagcggcgcctcagggatccctgagcgattctctggc
tccaactctgggaacacagccactctgaccatcagcgggacccaggctatggatgaggctgactattactgtcagacgtgggccagcggcatt
gtggtgttcggcggagggaccaagctgaccgtcctaggttctagaggtggtggtggtagcggcggcggcggctctggtggtggtggatccct
cgagatggcccaggtacagctgcagcagtcaggtccaggactggtgaagccctcgcagaccctctcactcacctgtgccatctccggggaca
gtgtctctagcaacagtgctgcttggaactggatcaggcagtccccatcgagaggccttgagtggctgggaaggacatactacaggtccaagt
ggtataatgattatgcagtatctgtgaaaagtcgaataaccatcaacccagacacatccaagaaccagttctccctgcagctgaactctgtgact
cccgaggacacggctgtgtattactgtgcaagagagcgcagtggctggaagggatttgactactggggccagggaaccctggtcaccgtctcct
caactagtggccaggccggccagcaccatcaccatcaccatggcgcatacccgtacgacgttccggactacgcttct [SEQ ID NO:
723]

Amino Acid Sequence
QPVLTQPPSVSVSPGQTAAIPCSGDKLGDKFASWYQQKPGQSPVLVIYQDTKRPSGIPERFS
GSNSGNTATLTISGTQAMDEADYYCQTWASGIVVFGGGTKLTVLGSRGGGGSGGGGSGG
GGSLEMAQVQLQQSGPGLVKPSQTLSLTCAISGDSVSSNSAAWNWIRQSPSRGLEWLGRT
YYRSKWYNDYAVSVKSRITINPDTSKNQFSLQLNSVTPEDTAVYYCARERSGWKGFDYW
GQGTLVTVSSTSGQAGQHHHHHGAYPYDVPDYAS [SEQ ID NO: 724]

TABLE 143

ET200-117
DNA Sequence
gatgttgtgatgactcagtctccaccctccctgtccgtcaccctggagagccggcctccatcacctgcaggtctagtcagagcctcctggaaag
aaatgcataacaactacttggattggtacctgcagaggccaggacagtctccacagcctgatctacttgggttctaatcgggccgccgggggtcc
ctgacaggttcagtggcagtggatcaggcagagattttacactgaaaatcagcagagtgaggcctgaggatgttggggtttattactgcatgcaa
gctctacaagctccgttcacttttcggcggagggaccaaggtggagatcaaacgttctagaggtggtggtggtagcggcggcggcggctctggt
ggtggtggatcccctcgagatggccgaagtgcagctggtgcagtctggggggaggcttggtacagcctggggggtcccctgagactctcctgtgc
agcctctggattcacctttagcagctatgccatgagctgggtccgccaggctccagggaaggggctggagtgggtctcagctattagtggtagt
ggtggtagcacatactacgcagactccgtgaagggccggttcaccatctccagagacaattccaagaacacgctgtatctgcaaatgaacagc
ctgagagccgaggacacggccgtatattactgtgcgaaatgggggcccgtttcaggatgcttttgatatctgggggccaagggacaatggtcaccg
tctcttcaactagtggccaggccggccagcaccatcaccatcaccatggcgcataccgtacgacgttccggactacgcttct [SEQ ID
NO: 725]

Amino Acid Sequence
DVVMTQSPPSLSVTPGEPASITCRSSQSLLERNAYNYLDWYLQRPGQSPQLLIYLGSNRAA
GVPDRFSGSGSGRDFTLKISRVEPEDVGVYYCMQALQAPFTFGGGTKVEIKRSRGGGGSG
GGGSGGGGSLEMAEVQLVQSGGGLVQPGGSLRLSCAASGFTFSSYAMSWVRQAPGKGLE
WVSAISGSGGSTYYADSVKGRFTISRDNSKNTLYLQMNSLRAEDTAVYYCAKWGPFQDA
FDIWGQGTMVTVSSTSGQAGQHHHHHHGAYPYDVPDYAS [SEQ ID NO: 726]

TABLE 144

ET200-118
DNA Sequence
caggctgtgctgactcagcctgcctccgtgtctgggtctcctggacagtcgatcaccatctcctgcactggaaccagcagtgacgttggtggtta
taactatgtctcctggtaccaacagcacccgggcaaagcccccaaactcatgatttatgaggtcagtaatcggccctcaggggtttctaatcgct
tctctggctccaagtctggcaacacggcctccctgaccatctctgggctccaggctgaggacgaggctgattattactgcagctcatatacaagc
agcagcacccctctatgtcttcggacaggagccaaggtcaccgtcctaggtctagaggtggtggtggtagcggcggcggcggctctggtggtgg
tggatcccctcgagatggccgaggtgcagctggtggagtctggggggaggcttggtacagcctggcaggtccctgagactctcctgtgcagcctc
tggattcacctttgatgattatgccatgcactgggtccggcaagctccagggaagggcctggagtgggtctcaggtattagtggaatagtggta
gcataggctatgcggactctgtgaagggccgattcaccatctccagagacaacgccaagaactccctgtatctgcaaatgaacagtctgagagc
tgaggacacggccttgtattactgtgcaaaagccaggtggacagcagtggcatcagaccaccactttgactactggggccagggaacgctggt
caccgtctcctcaactagtggccaggccggccagcaccatcaccatcaccatggcgcataccgtacgacgttccggactacgcttct [SEQ
ID NO: 727]

Amino Acid Sequence
QAVLTQPASVSGSPGQSITISCTGTSSDVGGYNYVSWYQQHPGKAPKLMIYEVSNRPSGVS
NRFSGSKSGNTASLTISGLQAEDEADYYCSSYTSSSTPYVFGAGTKVTVLGSRGGGGSGGG
GSGGGGSLEMAEVQLVESGGGLVQPGRSLRLSCAASGFTFDDYAMHWVRQAPGKGLEW
VSGISWNSGSIGYADSVKGRFTISRDNAKNSLYLQMNSLRAEDTALYYCAKARWTAVASD
HHFDYWGQGTLVTVSSTSGQAGQHHHHHHGAYPYDVPDYAS [SEQ ID NO: 728]

TABLE 145

ET200-119
DNA Sequence
caggctgtgcttactcagccaccctcagcgtctgggaccccgggcagagggtcaccatctcttgttctggaagcagctccaacatcggaagta
atactgtaaactggtaccagcagctcccaggaacggccccaaactcctcatctatagtaataatcagcggccctcaggggtcccctgaccgatt
ctctggctccaagtctggcacctcagcctccctggccatcagtgggctccagtctgaggatgaggctgattattactgtgcagcatgggatgaca
gcctgaatggttatgtcttcggaactgggaccaagctgaccgtcctaggttctagaggtggtggtggtagcggcggcggcggctctggtggtg
gtggatcccctcgagatggccgaggtgcagctggtgcagtctggggctgaggtgaagaagcctgggtcctcggtgaaggtctcctgcaaggctt
ctggaggcaccttcagcagctatgctatcagctgggtgcgacaggcccctggacaagggcttgagtggatgggagggatcatccctatctttgg
tacagcaaactacgcacagaagttccagggcagagtcacgattaccgcggacgaatccacgagcacagcctacatggagctgagcagcctg
agatctgaggacacggccgtgtattactgtgcgagagattgggactacatggacgtctggggcaagggaccacggtcaccgtctcctcaact
agtggccaggccggccagcaccatcaccatcaccatggcgcataccgtacgacgttccggactacgcttct [SEQ ID NO: 729]

Amino Acid Sequence
QAVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKLTVLGSRGGGGSGGGG
SGGGGSLEMAEVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARDWDYMDVWGKG
TTVTVSSTSGQAGQHHHHHHGAYPYDVPDYAS [SEQ ID NO: 730]

TABLE 146

ET200-120
DNA Sequence
tcctatgagctgactcagccaccctcagcgtctgggaccccgggcagagggtcaccatctcttgttctggaagcagctccaacatcggaagta
atactgtaaactggtaccagcagctcccaggaacggcccccaaactcctcatctatagtaataatcagcggccctcaggggtccctgaccgatt
ctctggctccaagtctggcacctcagcctccctggccatcagtgggctccagtctgaggatgaggctgattattactgtgcagcatgggatgaca
gcctgaatggttatgtcttcggaactgggaccaaggtcaccgtcctaggttctagaggtggtggtggtagcggcggcggcggctctggtggtg
gtggatccctcgagatggccgaggtgcagctggtggagtctggagctgaggtgaagaagcctggggcctcagtgaaggtctcctgcaaggct
tctggttacacctttaccagctatggtatcagctgggtgcgacaggcccctggacaagggcttgagtggatgggatggatcagcgcttacaatg
gtaacacaaactatgcacagaagctcccagggcagagtcaccatgaccacagacacatccacgagcacagcctacatggagctgaggagcct
gagatctgacgacacggccgtgtattactgtgcgagagacctatctcggggagctaaccgcattactactactactacggtatggacgtctggg
gccaagggaccacggtcaccgtctcctcaactagtggccaggccggccagcaccatcaccatcaccatggcgcatacccgtacgacgttccg
gactacgcttct [SEQ ID NO: 731]

Amino Acid Sequence
SYELTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKVTVLGSRGGGGSGGGG
SGGGGSLEMAEVQLVESGAEVKKPGASVKVSCKASGYTFTSYGISWVRQAPGQGLEWMG
WISAYNGNTNYAQKLQGRVTMTTDTSTSTAYMELRSLRSDDTAVYYCARDLSRGANPHY
YYYYGMDVWGQGTTVTVSSTSGQAGQHHHHHHGAYPYDVPDYAS [SEQ ID NO: 732]

TABLE 147

ET200-121
DNA Sequence
cagtctgtgttgacgcagccgccctcagtgtctggggccccagggcagagggtcaccgtctcctgcactgggagcagatccaacatcggggc
aggatatgatgtacactggtaccagcaacttccaggaacagcccccaaactcctcatctatggaaatagtaatcggcctccaggggtccctgac
cgattctctgggtctaagtctggcacctcagcctccctggtcatcactgggctccaggctgaggatgccgctgattattactgccagtcctatga
caacactgtgcgtaatcacctatgtcttcggaactgggaccaaggtcaccgtcctaggttctagaggtggtggtggtagcggcggcggcggct
ctggtggtggtggatccctcgagatggccgaggtgcagctggtgcagtctggggctgaggtgaagaagcctggggcctcagtgaaggtctcct
gcaaggtttccggatacacccttactgaattatccatgcactgggtgcgacaggctcctggaaaagggcttgagtggatgggaggttttgatcct
gaagatggtgaaacaatctacgcacagaagttccagggcagagtcaccatgaccgaggacacatctacagacacagcctacatggagctgag
cagcctgagatctgaggacacggccgtgtattactgtgcaacagagagtaatttagtgtcccggcactactactactacggtatggacgtctggg
gccaagggaccacggtcaccgtctcctcaactagtggccaggccggccagcaccatcaccatcaccatggcgcatacccgtacgacgttccg
gactacgcttct [SEQ ID NO: 733]

Amino Acid Sequence
QSVLTQPPSVSGAPGQRVTVSCTGSRSNIGAGYDVHWYQQLPGTAPKLLIYGNSNRPPGVP
DRFSGSKSGTSASLVITGLQAEDAADYYCQSYDNTVRESPYVFGTGTKVTVLGSRGGGGS
GGGGSGGGGSLEMAEVQLVQSGAEVKKPGASVKVSCKVSGYTLTELSMHWVRQAPGKG
LEWMGGFDPEDGETIYAQKFQGRVTMTEDTSTDTAYMELSSLRSEDTAVYYCATESNLVS
RHYYYYGMDVWGQGTTVTVSSTSGQAGQHHHHHHGAYPYDVPDYAS [SEQ ID NO: 734]

TABLE 148

ET200-122
DNA Sequence
ctgcctgtgctgactcagccaccctcagcgtctgggaccccgggcagagggtcaccatctcttgttctggaaccagctccaacatcggaagta
attctgtagactggtaccagcagctcccaggaacggcccccaaactcctcatctatagtaataatcagcggccctcaggggtccctgaccgaat
ctctggctccaagtctggcacctcagcctccctggccatcagtgggctccagtctgaggatgaggctgattattactgtgcagcatgggatgaca
gcctgaatggttatgtcttcggaactgggaccaaggtcaccgtcctaggttctagaggtggtggtggtagcggcggcggcggctctggtggtg
gtggatccctcgagatggccgaagtgcagctggtgcagtctggggctgaggtgaagaagcctggggcctcagtgaaggtctcctgcaaggct
tctggatacaccttcaccggctactatatgcactgggtgcgacaggcccctggacaagggcttgagtggatgggatggatcaaccctaacagtg
gtggcacaaactatgcacagaagtttcagggcagggtcaccatgaccagggacacgtccatcagcacagcctacatggagctgagcaggctg
agatctgacgacacggccgtgtattactgtgcgagagattacggatactatggttcggggagttattcgagcggccccttactactactacgg
tatggacgtctggggccaagggaccacggtcaccgtctcctcaactagtggccaggccggccagcaccatcaccatcaccatggcgcatacc
gtacgacgttccggactacgcttct [SEQ ID NO: 735]

Amino Acid Sequence
LPVLTQPPSASGTPGQRVTISCSGTSSNIGSNSVDWYQQLPGTAPKLLIYSNNQRPSGVPDRI
SGSKSGTSASLAISGLQSEDEADYYCAAWDDSLNGYVFGTGTKVTVLGSRGGGGSGGGGS
GGGGSLEMAEVQLVQSGAEVKKPGASVKVSCKASGYTFTGYYMHWVRQAPGQGLEWM
GWINPNSGGTNYAQKFQGRVTMTRDTSISTAYMELSRLRSDDTAVYYCARDYGYYGSGS
YSSGPLYYYYGMDVWGQGTTVTVSSTSGQAGQHHHHHHGAYPYDVPDYAS [SEQ ID NO: 736]

TABLE 149

ET200-123
DNA Sequence
caggctgtgctgactcagccaccctcagcgtctgggaccccgggcagagggtcaccatctcttgttctggaagcagctccaacatcggaagt
aatactgtaaactggtaccagcagctcccaggaacggcccccaaactcctcatgtataataatgatcagcggccctcaggggtccctgaccgat
tctctggctccaagtctggcacctcagcctccctggccatcagtgggctccagtctgaggatgaggctgattattactgtgcagcatgggatgac
agcctcaatggttatgtcttcggacctgggaccaaggtcaccgtcctaggttctagaggtggtggtggtagcggcggcggcggctctggtggtg
gtggatccctcgagatggcccaggtgcagctggtggagtctggagctgaggtgaagaagcctggggcctcagtgaaggtctcctgcaaggct
tctggttacacctttaccagctatggtatcagctgggtgcgacaggcccctggacaagggcttgagtggatgggatggatcagcgcttacaatg
gtaacacaaactatgcacagaagctccagggcagagtcaccatgaccacagacacatccacgagcacagcctacatggagctgaggagcct
gagatctgacgacacgccgtgtattactgtgcgagagacctatccggggagctaaccgcattactactactactacggtatggacgtctggg
gccaagggaccacggtcaccgtctcctcaactagtggccaggccggccagcaccatcaccatcaccatggcgcatacccgtacgacgttccg
gactacgcttct [SEQ ID NO: 737]

Amino Acid Sequence
QAVLTQPPSASGTPGQRVTISCSGSSSNIGSNTVNWYQQLPGTAPKLLMYNNDQRPSGVPD
RFSGSKSGTSASLAISGLQSEDEADYYCAAWDDSLNGYVFGPGTKVTVLGSRGGGGSGGG
GSGGGGSLEMAQVQLVESGAEVKKPGASVKVSCKASGYTFTSYGISWVRQAPGQGLEW
MGWISAYNGNTNYAQKLQGRVTMTTDTSTSTAYMELRSLRSDDTAVYYCARDLSRGANP
HYYYYYGMDVWGQGTTVTVSSTSGQAGQHHHHHHGAYPYDVPDYAS [SEQ ID NO: 738]

TABLE 150

ET200-125
DNA Sequence
aattttatgctgactcagccccacgctgtgtcggagtctccggggaagacggtaaccatctcctgcacccgcagcagtggcagtattgccagca
actatgtgcagtggtaccagcagcgcccgggcagttccccccgcactgtgatttatgaggataatcaaagaccctctggggtccctggtcggttc
tctggctccatcgacagctcctccaactctgcctccctcaccatctctggactgaagactgaggacgaggctgactactactgtcagtcttatga
ttccaccagtgtgcttttcggcggagggaccaagctgaccgtcctaggttctagaggtggtggtggtagcggcggcggcggctctggtggtggtg
gatccctcgagatggccgaggtccagctggtgcagtctggggctgaggtgaagaagccaggtcctcggtgaaggtctcctgcaaggcctcg
ggaggcaccttcagcagcaattctctcagctgggtgcgacaggcccctggacaagggcttgagtggatgggaaggatcttccctatcctggt
ataacaaactatgcacagaagttccagggcagagtcacgattaccgcggacaaatccacgagcacagcctacatggagctgagcagcctgag
atctgaggacacggccgtctattactgtgcgagaggaaactaccaatggtatgatgcttttgatatctggggccaagggacaatggtcaccgtct
cttcaactagtggccaggccggccagcaccatcaccatcaccatggcgcatacccgtacgacgttccggactacgcttct [SEQ ID NO:
739]

Amino Acid Sequence
NFMLTQPHAVSESPGKTVTISCTRSSGSIASNYVQWYQQRPGSSPRTVIYEDNQRPSGVPGR
FSGSIDSSSNSASLTISGLKTEDEADYYCQSYDSTSVLFGGGTKLTVLGSRGGGGSGGGGSG
GGGSLEMAEVQLVQSGAEVKKPGSSVKVSCKASGGTFSSNSLSWVRQAPGQGLEWMGRI
FPILGITNYAQKFQGRVTITADKSTSTAYMELSSLRSEDTAVYYCARGNYQWYDAFDIWG
QGTMVTVSSTSGQAGQHHHHHHGAYPYDVPDYAS [SEQ ID NO: 740]

TABLE 151

ET200-005
DNA Sequence
cagcctgtgctgactcagccaccctcagtgtcagtggtcccaggaaagacggccaggattacctgtgggggaaaaaacattggaagtaaaagt
gtgcactggtaccagcagaagccaggccaggcccctgtggtggtcatccattatgatagtgaccggccctcagggatccctgagcgattctctg
gctccaactctgggaacacggccaccctgaccatcagcagggtcgaagccggggatgaggccgactattactgtcaggtgtgggatagtagt
agtgatcatccttatgtcttcggaactgggaccaaggtcaccgtcctaggttctagaggtggtggtggtagcggcggcggcggctctggtggtg
gtggatccctcgagatggcccaggtgcagctggtgcagtctggagctgaggtgaagaagcctggggcctcagtgaaggtctcctgcaaggct
tctggttacacctttaccaactatggtatcagctgggtgcgacaggcccctggacaagggcttgagtggatgggatggatcagcgcttacaatgg
taacacaaactatgcacataagctccagggcagagtcaccatgaccacagacacatccacgagcacagccaacatggagctgaggagcctg
agacctgacgacactgccgtgtattactgtgcgcgctcttacttcggttctcatgattactgggtcaaggtactctggtgaccgtctcctcaac
tagtggccaggccggccagcaccatcaccatcaccatggcgcatacccgtacgacgttccggactacgcttct [SEQ ID NO: 741]

Amino Acid Sequence
QPVLTQPPSVSVVPGKTARITCGGKNIGSKSVHWYQQKPGQAPVVVIHYDSDRPSGIPERFS
GSNSGNTATLTISRVEAGDEADYYCQVWDSSSDHPYVFGTGTKVTVLGSRGGGGSGGGG
SGGGGSLEMAQVQLVQSGAEVKKPGASVKVSCKASGYTFTNYGISWVRQAPGQGLEWM
GWISAYNGNTNYAHKLQGRVTMTTDTSTSTANMELRSLRPDDTAVYYCARSYFGSHDY
WGQGTLVTVSSTSGQAGQHHHHHHGAYPYDVPDYAS [SEQ ID NO: 742]

TABLE 152

ET200-124
DNA Sequence
tcctatgtgctgactcagccaccctcggtgtcagtggccccaggaaagacggccaggatttcctgtgggggaaacgacattggaagtaaaagt
gttttctggtatcagcagaggccaggccaggcccctgtgttggtcgtctatgatgatagcgaccggccctcagggctccctgagcgattctctgg
cttcaactctgggaacacggccaccctgaccatcagcagggtcgaagcgggggatgaggccgactattactgtcaagtgtgggatagtagtag
tgatcattatgtcttcggaactgggaccaagtcaccgtcctaggttctagaggtggtggtggtagcggcggcggcggctctggtggtggtgga
tccctcgagatggcccaggtgcagctggtggagtctgggggaggcttggtacagcctggcaggtccctgagactctcctgtgcagcctctgga
ttcacctttgatgattatgccatgcactgggtccggcaagctccagggaagggcctggagtgggtctcaggtattagttggaatagtggtagcat
aggctatgcggactctgtgaagggccgattcaccatctccagagacaacgccaagaactccctgtatctgcaaatgaacagtctgagagctgag
gacacggccttgtattactgtgcaaaagatataacctatggttcggggagttatgctgcttttgatatctggggccaagggacaatggtcaccgt
ctcttcaactagtggccaggccggccagccatcaccatcaccatggcgcataccgtacgacgttccggactacgcttct [SEQ ID NO: 743]

Amino Acid Sequence
SYVLTQPPSVSVAPGKTARISCGGNDIGSKSVFWYQQRPGQAPVLVVYDDSDRPSGLPERF
SGFNSGNTATLTISRVEAGDEADYYCQVWDSSSDHYVFGTGTKVTVLGSRGGGSGGGG
SGGGGSLEMAQVQLVESGGGLVQPGRSLRLSCAASGFTFDDYAMHWVRQAPGKGLEWV
SGISWNSGSIGYADSVKGRFTISRDNAKNSLYLQMNSLRAEDTALYYCAKDITYGSGSYGA
FDIWGQGTMVTVSSTSGQAGQHHHHHHGAYPYDVPDYAS [SEQ ID NO: 744]

Exemplary Anti-FcRL5 Antibodies Comprising a Heavy Chain Variable Region, a Light Chain Variable Region, a Linker Peptide and a His-Tag and HA-Tag

TABLE 153

ET200-001
DNA Sequence
Cagtctgtgttgacgcagccaccctcagcgtctgggaccccgggcagagggtcaccatctcttgttctggaagcagctccaacatcggaagt
aatactgtaaactggtaccagcagctcccaggaacgcccccaaactcctcatctatagtaataatcagcggccctcaggggtccctgaccgat
tctctggctccaagtctggcacctcagcctcctggccatcagtgggctccagtctgaggatgaggctgattattactgtgcagcatgggatgac
agcctgaatggttatgtcttcggaactgggaccaagtcaccgtcctaggttctagaggtggtggtggtagcggcggcggcggctctggtggtg
gtggatccctcgagatggcccaggtgcagctacagcagtggggcgcaggactgttgaagccctgtccctcacctgcgctgtgt
atggtgggtccttcagtggttactactggagctggatccgccagcccccagggaagggctggagtggattgggggaaatcaatcatagtggaa
gcaccaactacaacccgtccctcaagagtcgagtcaccatatcagtagacacgtccaagaaccagttctccctgaagctgagctctgtgaccgc
cgcggacacggccgtgtattactgtgcgcgcgaaggtccgtacgacggtttcgattcttgggtcaaggtactctggtgaccgtctcctcaacta
gtggccaggccggccagccatcaccatcaccatggcgcataccgtacgacgttccggactacgcttct [SEQ ID NO: 745]

Amino Acid Sequence
QSVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKVTVLGSRGGGSGGGG
SGGGGSLEMAQVQLQQWGAGLLKPSETLSLTCAVYGGSFSGYYWSWIRQPPGKGLEWIG
EINHSGSTNYNPSLKSRVTISVDTSKNQFSLKLSSVTAADTAVYYCAREGPYDGFDSWGQG
TLVTVSSTSGQAGQHHHHHHGAYPYDVPDYAS [SEQ ID NO: 746]

TABLE 154

ET200-002
DNA Sequence
Aattttatgctgactcagcccactctgtgtcggagtctccggggaagacggtaaccatctcctgcacccgcagcagtggcagcattgccagca
actatgtgcagtggtaccagcagcgcccgggcagtgccccaccactgtgatctatgaggataaccaaagaccctctggggtccctgatcggtt
ctctggctccatcgacagctcctccaactctgcctccctcaccatctctggactgaagactgaggacgaggctgactactactgtcagtcttatg
atagcagcaattctgtggtattcggcggagggaccaagctgaccgtcctaggttctagaggtggtggtggtagcggcggcggcggctctggtggt
ggtggatccctcgagatggcccaggtccagctggtacagtctggcactgaggtgaagaagcctggggcctcagtgagggtcgcctgcaagg
cttctggttaccccttaacaaatatgacatcaactgggtgcgacaggcccctggacaagggcttgagtggatgggaggcatcatccctatcttt
cgtacaacaaactacgcacagaagttccagggcagagtcacgattaccgcggacgaatccacgagcacagcctacatggagctgagcagcct
gagatctgaggacacggccgtatattactgtgcgcgcgaatggttctactgggatatctgggtcaaggtactctggtgaccgtctcctcaacta
gtggccaggccggccagccatcaccatcaccatggcgcataccgtacgacgttccggactacgcttct [SEQ ID NO: 747]

Amino Acid Sequence
NFMLTQPHSVSESPGKTVTISCTRSSGSIASNYVQWYQQRPGSAPTTVIYEDNQRPSGVPDR
FSGSIDSSSNSASLTISGLKTEDEADYYCQSYDSSNSVVFGGGTKLTVLGSRGGGSGGGGS
GGGGSLEMAQVQLVQSGTEVKKPGASVRVACKASGYPFNKYDINWVRQAPGQGLEWMG
GIIPIFRTTNYAQKFQGRVTITADESTSTAYMELSSLRSEDTAVYYCAREWFYWDIWGQGT
LVTVSSTSGQAGQHHHHHHGAYPYDVPDYAS [SEQ ID NO: 748]

TABLE 155

ET200-003
DNA Sequence
Cagtctgtgttgactcagccaccctcagtgtccgtgtccccaggacagacagccagcatctcctgctctggaaataaattggggactaagtatgt
ttactggtatcagaagaggccaggccagtcccctgtgttggtcatgtatgaagataatcagcggccctcagggatcccggagcggttctctggct
ccaactctgggaacacagccactctgaccatcagagggaccgagctgtggatgaggctgactattactgtcaggcgtgggactccgacacttt
cgtggtcttcggcggagggaccaaggtcaccgtcctaggttctagaggtggtggtggtagcggcggcggcggctctggtggtggtggatccc
tcgagatggccgaggtgcagctggtggagaccgggggaggcgtggtccagcctggaggtccctgagactctcctgtgcagcctctggattc
accttcagtagttatggcatgcactgggtccgccaggctccaggcaaggggctggagtgggtggcagttatatcacatgatggaagtaataaat
actacgcagactccgtgaaggcgccgattcaccatctccagagacaattccaaggacacgctgtatctgcaaatgaacagcctgagaggtgagg
acacggccgtatattactgtgcgcgctctaaccagtggtctggttacttctctttcgattactggggtcaaggtactctggtgaccgtctcctc
aactagtggccaggccggccagcaccatcaccatcaccatggcgcatacccgtacgacgttccggactacgcttct [SEQ ID NO: 749]

Amino Acid Sequence
QSVLTQPPSVSVSPGQTASISCSGNKLGTKYVYWYQKRPGQSPVLVMYEDNQRPSGIPERF
SGSNSGNTATLTIRGTQTVDEADYYCQAWDSDTFVVFGGGTKVTVLGSRGGGGSGGGGS
GGGGSLEMAEVQLVETGGGVVQPGRSLRLSCAASGFTFSSYGMHWVRQAPGKGLEWVA
VISHDGSNKYYADSVKGRFTISRDNSKDTLYLQMNSLRGEDTAVYYCARSNQWSGYFSFD
YWGQGTLVTVSSTSGQAGQHHHHHHGAYPYDVPDYAS [SEQ ID NO: 750]

TABLE 156

ET200-006
DNA Sequence
Tcctatgtgctgactcagccaccctcagtgtcagtggccccaggaaagacggccaggattacctgtgggggaaacaacattggaagtaaaag
tgtgcactggtaccagcagaagccaggccaggcccctgtggtggtcatccattatgatagcgaccggccctcagggatccctgagcgattctct
ggctccaactctgggaacacggccaccctgaccatcagcagggtcgaagccggggatgaggccgactattactgtcaggtgtgggatagtag
tagtgatcatcctatgtcttcggaactgggaccaaggtcaccgtcctaggttctagaggtggtggtggtagcggcggcggcggctctggtggtg
gtggatccctcgagatggccgaggtgcagctggtgcagtctggagctgaggtgaagaagcctggggcctcagtgaaggtctcctgcaaggct
tctggttacacctttaccacctatggtatcagctgggtgcgacaggcccctggacaagggcttgagtggatgggatggatcaacacttacaatgg
tcacacaaactatgcacagaagctccagggcagagccacaatgaccgcagacacatccacgaacacagcctacatggagctgaggagcctg
agatctgacgacactgccgtgtattactgtgcgcgcttatctacggttctggtgattactggggtcaaggtactctggtgaccgtctcctca
actagtggccaggccggccagcaccatcaccatcaccatggcgcatacccgtacgacgttccggactacgcttct [SEQ ID NO: 751]

Amino Acid Sequence
SYVLTQPPSVSVAPGKTARITCGGNNIGSKSVHWYQQKPGQAPVVVIHYDSDRPSGIPERFS
GSNSGNTATLTISRVEAGDEADYYCQVWDSSSDHPYVFGTGTKVTVLGSRGGGGSGGGG
SGGGGSLEMAEVQLVQSGAEVKKPGASVKVSCKASGYTFTTYGISWVRQAPGQGLEWM
GWINTYNGHTNYAQKLQGRATMTADTSTNTAYMELRSLRSDDTAVYYCARVIYGSDY
WGQGTLVTVSSTSGQAGQHHHHHHGAYPYDVPDYAS [SEQ ID NO: 752]

TABLE 157

ET200-007
DNA Sequence
Tcctatgtgctgactcagccactctcagtgtcagtggccccaggaaagacggccaggattacctgtgggggaaacaacattggaagtaaaact gtgcactggtaccagcagaagccaggccaggcccctgtgctggtcatctattatgatagcgaccggccctcagggatccctgagcgattctctg gctccaactctgggaacacggccaccctgaccatcagcagggtcgaagccggggatgaggccgactattactgtcaggtgtgggatagtagt agtgatcatcgggtgttcggcggagggaccaagctgaccgtcctaggttctagaggtggtggtggtagcggcggcggcggctctggtggtgg tggatccctcgagatggccaggtgcagctgcaggagtcggggcccaggactggtgaagccttcggagaccctgtccctcacctgcaatgtctc tggttactccatcagcagtggttacttttggggctggatccggcagcccccagggaaggggctggagtggattgggagtatctatcatagtagg agcacctactacaaccgtccctcaagagtcgagtcaccatatcagtagacacgtccaagaaccagttctccctgaagctgaactctgtgaccg ccgcagacacggccgtgtattactgtgcgcgcggttacggttacttcgattactggggtcaaggtactctggtgaccgtctcctcaactagtgg ccaggccggccagcaccatcaccatcaccatggcgcatacccgtacgacgttccggactacgcttct [SEQ ID NO: 753]

Amino Acid Sequence
SYVLTQPLSVSVAPGKTARITCGGNNIGSKTVHWYQQKPGQAPVLVIYYDSDRPSGIPERFS

GSNSGNTATLTISRVEAGDEADYYCQVWDSSSDHRVFGGGTKLTVLGSRGGGGSGGGGS

GGGGSLEMAQVQLQESGPGLVKPSETLSLTCNVSGYSISSGYFWGWIRQPPGKGLEWIGSI

YHSRSTYYNPSLKSRVTISVDTSKNQFSLKLNSVTAADTAVYYCARGYGYFDYWGQGTLV

TVSSTSGQAGQHHHHHHGAYPYDVPDYAS [SEQ ID NO: 754]

TABLE 158

ET200-008
DNA Sequence
Caatctgccctgactcagcctgcctccgtgtctgggtctcctggacagtcgatcaccatctcctgcactggaaccagcagtgacgttggtgg
ttataactatgtctcctggtaccaacaacacccaggcaaagcccccaaactcatgatttatgatgtcagtaatcggccctcaggggtttctaa
tcgcttctctggctccaagtctggcaacacggcctccctgaccatctctgggctccaggctgaggacgaggctgattattactgcagctcatat
acaagcagcagcacttcgaaggtgttcggcggagggaccaagctgaccgtcctaggttctagaggtggtggtggtagcggcggcggcg
gctctggtggtggtggatcccctcgagatggccgaggtgcagctggtggagtctggggaggtgtggtacggcctgggggtccctgagact
ctcctgtgcagcctctggattcacctttggtgattatggcatgagctgggtccgccaagctccagggaagggggctggagtgggtctctggtatta
attggaatggtggtagcacaggttatgcagactctgtgaagggccgattcaccatctccagagacaacgccaagaactccctgtatctgcaa
atgaacagtctgagagccgaggacacggccgtatattactgtgcgcgctctaaatacaacttccatgtttactacgattactgggtcaaggta
ctctggtgaccgtctcctcaactagtggccaggccggccagcaccatcaccatcaccatggcgcataccgtacgacgttccggactacgct
tct [SEQ ID NO: 755]

Amino Acid Sequence
QSALTQPASVSGSPGQSITISCTGTSSDVGGYNYVSWYQQHPGKAPKLMIYDVSNRPSGVS
NRFSGSKSGNTASLTISGLQAEDEADYYCSSYTSSSTSKVFGGGTKLTVLGSRGGGSGGG
GSGGGGSLEMAEVQLVESGGGVVRPGGSLRLSCAASGFTFGDYGMSWVRQAPGKGLEW
VSGINWNGGSTGYADSVKGRFTISRDNAKNSLYLQMNSLRAEDTAVYYCARSKYNFHVY
YDYWGQGTLVTVSSTSGQAGQHHHHHHGAYPYDVPDYAS [SEQ ID NO: 756]

TABLE 159

ET200-009
DNA Sequence
Cagtctgtgttgacgcagccaccctcagcgtctgggaccccgggcagacagtcaccatctcttgttctggaagcaactccaacatcggaagt
aattatgtatactggtaccagcagctcccaggaacggcccccaaactcctcatctataggaataatcagcggccctcaggggtccctgaccgatt
ctcaggctccaagtctggcacctcagcctccctggccatcagtgggctccgctccgaggatgaggctgattattactgtgcagcatgggatgac
agcctgagtgcttatgtcttcggaactgggaccaaggtcaccgtcctaggttctagaggtggtggtggtagcggcggcggcggctctggtggtg
gtggatcccgagatggccaggtgcagctggtgcagtctggagctgaggtgaagaagcctggggcctcagtgaaggtctcctgcaaggct
tctggttacaccttaccagctatggtatcagctgggtgcgacaggcccgacaaggctgagtggatgggatggatcagcgcttacaatg
gtaacacaaactatgcacagaagctccagggcagagtcaccatgaccacagacacatccacgagcacagcctacatggagctgaggagcct
gagatctgacgacactgccgtgtattactgtgcgcgctcttctggtaacatggtttcttggaaagatatgtggggtcaaggtactctggtgac
cgtctcctcaactagtggccaggccggccagcaccatcaccatcaccatggcgcataccgtacgacgttccggactacgcttct [SEQ ID
NO: 757]

Amino Acid Sequence
QSVLTQPPSASGTPGQTVTISCSGSNSNIGSNYVYWYQQLPGTAPKLLIYRNNQRPSGVPDR
FSGSKSGTSASLAISGLRSEDEADYYCAAWDDSLSAYVFGTGTKVTVLGSRGGGSGGGG
SGGGGSLEMAQVQLVQSGAEVKKPGASVKVSCKASGYTFTSYGISWVRQAPGQGLEWM
GWISAYNGNTNYAQKLQGRVTMTTDTSTSTAYMELRSLRSDDTAVYYCARSSGNMVSW
KDMWGQGTLVTVSSTSGQAGQHHHHHHGAYPYDVPDYAS [SEQ ID NO: 758]

TABLE 160

ET200-010
DNA Sequence
Caatctgccctgactcagcctgcctccgtgtctgggtctcctggacagtcgatcaccatctcctgcactggaaccagcagtgacgttggtgg
ttataactctgtctcctggtaccaacaacacccaggcaaagcccccagactcatgatttatgatgtcagtaatcggccctcaggggtttctaa
tcgcttctctggctccaagtctggcaacacggcctccctgaccatctctgggctccaggctgaggacgaggctgattattactgcagctcata
tacaagcagcagcaccccttagtcttcggaactgggaccaaggtcaccgtcctaggttctagaggtggtggtggtagcggcggcggcg
gctctggtggtggtggatcccctcgagatggcccaggtgcagctggtgcagtctgggctgaggtgaagaagcctggggcctcagtgaag
gtctcctgcaaggcttctggttacacctttaccagctatggtatcagctgggtgcgacaggcccctggacaagggcttgagtggatgggatg
gatcagcgcttacaatggtaacacaaactatgcacagaagctccagggcagagtcaccatgaccacagacacatccacgagcacag
cctacatggagctgaggagcctgagatctgacgacacggccgtgtattactgtgcgcgcggtgctgttgcttaccatgattgggtcaaggt
actctggtgaccgtctcctcaactagtggccaggccggccagcaccatcaccatcaccatggcgcataccgtacgacgttccggactac
gcttct [SEQ ID NO: 759]

Amino Acid Sequence
QSALTQPASVSGSPGQSITISCTGTSSDVGGYNSVSWYQQHPGKAPRLMIYDVSNRPSGVS
NRFSGSKSGNTASLTISGLQAEDEADYYCSSYTSSSTPLVFGTGTKVTVLGSRGGGSGGG
GSGGGGSLEMAQVQLVQSGAEVKKPGASVKVSCKASGYTFTSYGISWVRQAPGQGLEW
MGWISAYNGNTNYAQKLQGRVTMTTDTSTSTAYMELRSLRSDDTAVYYCARGAVAYHD
WGQGTLVTVSSTSGQAGQHHHHHHGAYPYDVPDYAS [SEQ ID NO: 760]

TABLE 161

ET200-011
DNA Sequence
Cagtctgtcgtgacgcagccgccctcagtgtctgcggccccaggacagagggtcaccatctcctgctctggaagcagctccaacatttcgattt
atgatgtatcctggtatcagcagctcccaggaacagcccccaaactcctcatttatgcaataataagcgaccctcggggattgctgaccgatt
ctctggctccacgtctggcacgtcagccaccctgggcatcaccggactccagactgggacgaggccgattattactgcggaacatgggatgac
agtctgagtgggggggtgttcggcggagggaccaagctgaccgtcctaggttctagaggtggtggtggtagcggcggcggcggctctggtg
gtggtggatccctcgagatggcccagatgcagctggtgcaatctggggctgaggtgaagaagcctgggtcctcggtgaaggtctcctgcgag
gcttctggaggcaccctcagcagctatgctatcaactgggtgcgacaggcccctggacaagggcttgagtggatgggagggatcatccctatg
tttggtacagcacactacgcacagaagttccagggcagagtcacgattaccgcggacgaatccacgaaaacagctacatggagctgagcag
cctgagatctgaggacactgccgtgtattactgtgcgcgcggtgttcattacgcttctttcgatcattgggtcaaggtactctggtgaccgtc
tcctcaactagtggccaggccggccagcaccatcaccatcaccatggcgcatacccgtacgacgttccggactacgcttct [SEQ ID NO: 761]

Amino Acid Sequence
QSVVTQPPSVSAAPGQRVTISCSGSSSNISIYDVSWYQQLPGTAPKLLIYGNNKRPSGIADRF
SGSTSGTSATLGITGLQTGDEADYYCGTWDDSLSGGVFGGGTKLTVLGSRGGGGSGGGGS
GGGGSLEMAQMQLVQSGAEVKKPGSSVKVSCEASGGTLSSYAINWVRQAPGQGLEWMG
GIIPMFGTAHYAQKFQGRVTITADESTKTAYMELSSLRSEDTAVYYCARGVHYASFDHWG
QGTLVTVSSTSGQAGQHHHHHHGAYPYDVPDYAS [SEQ ID NO: 762]

TABLE 162

ET200-012
DNA Sequence
Cagtctgtcgttgacgcagccgccctcagtgtctgcggccgcaggacagaaggtcaccatctcctgctctggaagcgactccaacattgggaat
aattatgtgtcctggtatcaacacctcccagggacagcccccaaactcctcatttatgacgtaaagaaccgctcctggaattcctgaccgg
ttctccggctccaagtctggctcgtcagccaccctaggcatcgccgactccagctggggacgaggccgattattactgcggaacatgggaca
gtcggctggatgcctatgtcttcggaactgggaccaaggtcaccgtcctaggttctagaggtggtggtggtagcggcggcggcggctctggtggt
ggtggatccctcgagatggcccagatgcagctggtgcaatctggagctgaggtgaagaagcctggggcctcagtgaaggtctcctgcaagac
ttctggtttcccctttaatatctttggaatcacctgggtgcgacaggcccctggacaagggcttgagtggatgggatggatcagcggttacaac
ggtaacacagactacccacagaagttccagggcagagtcaccatgtccacagacacatccacgagtacagcctacatggagctgaggaac
ctgaaatctgacgacacggccgtgtattactgtgcgcgcggtgcttacggtggtatggatacttgggtcaaggtactctggtgaccgtctcct
caactagtggccaggccggccagcaccatcaccatcaccatggcgcatacccgtacgacgttccggactacgcttct [SEQ ID NO: 763]

Amino Acid Sequence
QSVLTQPPSVSAAAGQKVTISCSGSDSNIGNNYVSWYQHLPGTAPKLLIYDVKNRPSGIPDR
FSGSKSGSSATLGIAGLQPGDEADYYCGTWDSRLDAYVFGTGTKVTVLGSRGGGGSGGG
GSGGGGSLEMAQMQLVQSGAEVKKPGASVKVSCKTSGFPFNIFGITWVRQAPGQGLEWM
GWISGYNGNTDYPQKFQGRVTMSTDTSTSTAYMELRNLKSDDTAVYYCARGAYGGMDT
WGQGTLVTVSSTSGQAGQHHHHHHGAYPYDVPDYAS [SEQ ID NO: 764]

TABLE 163

ET200-013
DNA Sequence
Cagtctgtcgtgacgcagccgccctcagtgtctggggccccagggcagagggtcaccatctcctgcactgggagcacctccaacatcgggg
caggttatgatgtacactggtatcagcagcttccaggaacagcccccaaactcctcatctatactaacaactttcggccctcaggggtccctga
ccgattctctgcctccaagtctggcacttcagcttccctggccatcactggtctccaggctgaggatgaggctgattattgcgggaacatgg
gatagcagcctgagtgccgttgtgttcggcggagggaccaagctgaccgtcctaggttctagaggtggtggtggtagcggcggcggcggctctg
gtggtggtggatccctcgagatggccgagtgcagctggtggagtctggaactgaggtgaagaagcctggggcctcagtgaaagtctcctgcaa
ggcttctggttacatgtttaccagttatggtctcaactgggtgcgacaggcccctggacaagggcttgagtggatgggatggatcagcgctaaca
atggtaagacaaattatgctaagaaattccaggacagagtcaccatgaccagagacacttccacgagcacaggctacatggaactgaggagcc
tgagatctgacgacacggccgtatattactgtgcgcgccatatcggtggttcttacttcgatcgttgggtcaaggtactctggtgaccgtct
cctcaactagtggccaggccggccagcaccatcaccatcaccatggcgcatacccgtacgacgttccggactacgcttct [SEQ ID NO: 765]

Amino Acid Sequence
QSVVTQPPSVSGAPGQRVTISCTGSTSNIGAGYDVHWYQQLPGTAPKLLIYTNNFRPSGVP
DRFSASKSGTSASLAITGLQAEDEADYYCGTWDSSLSAVVFGGGTKLTVLGSRGGGGSGG
GGSGGGGSLEMAEVQLVESGTEVKKPGASVKVSCKASGYMFTSYGLNWVRQAPGQGLE
WMGWISANNGKTNYAKKFQDRVTMTRDTSTSTGYMELRSLRSDDTAVYYCARHIGGSYF
DRWGQGTLVTVSSTSGQAGQHHHHHHGAYPYDVPDYAS [SEQ ID NO: 766]

TABLE 164

ET200-014
DNA Sequence
Tcctatgtgctgactcagccaccctcagtgtcagtggccccaggaaagacggccaggattacctgtgggggaaacaacattggaagtaaaag
tgtgcactggtaccagcagaagccaggccaggcccctgtgctggtcatctattatgatagcgaccggccctcagggatccctgagcgattctct
ggctccaactctgggaacacggccaccctgaccatcagcagggtcgaagccggggatgaggccgactattactgtcaggtgtgggatagtag
tagtgatcattatgtcttcggaactgggaccaaggtcaccgtcctaggttctagaggtggtggtggtagcggcggcggcggctctggtggtggt
ggatccctcgagatggccgaggtgcagctggtggagactggggaggcttggtacagcctggggggtccctgagactctcctgtgcagcctc
tggattcacctttagcagctatgccatgagctgggtccgccaggctccagggaaggggctggagtgggtctcagctattagtggtagtgatggt
agcacatactacgcagactccgtgaagggccggttcaccatctccagagacaattccaagaacacgctgtatctgcaaatgaacagcctgaga
gacgaggacacggccgtatattactgtgcgcgctctcatgaagctaacctggttggtgattggtgggtcaaggtactctggtgaccgtctcctc
aactagtggccaggccggccagcaccatcaccatcaccatggcgcatacccgtacgacgttccggactacgcttct [SEQ ID NO: 767]

Amino Acid Sequence
SYVLTQPPSVSVAPGKTARITCGGNNIGSKSVHWYQQKPGQAPVLVIYYDSDRPSGIPERFS
GSNSGNTATLTISRVEAGDEADYYCQVWDSSSDHYVFGTGTKVTVLGSRGGGGSGGGGS
GGGGSLEMAEVQLVETGGGLVQPGGSLRLSCAASGFTFSSYAMSWVRQAPGKGLEWVSA
ISGSDGSTYYADSVKGRFTISRDNSKNTLYLQMNSLRDEDTAVYYCARSHEANLVGDWW
GQGTLVTVSSTSGQAGQHHHHHHGAYPYDVPDYAS [SEQ ID NO: 768]

TABLE 165

ET200-015
DNA Sequence
Cagtctgtggtgactcagccaccctcagtgtcagtggccccaggaaagacggccaggattacctgtgggggaaacaacattggaagtaaaag
tgtgcactggtaccagcagaagccaggccaggcccctgtgctggtcatctattatgatagcgaccggccctcagggatccctgagcgattctct
ggctccaactctgggaacacggccaccctgaccatcagcagggtcgaagccggggatgaggccgactattactgtcaggtgtgggatagtag
tagtgatgtggtattcggcggagggaccaagctgaccgtcctaggttctagaggtggtggtggtagcggcggcggcggctctggtggtggtgg
atccctcgagatggccgaggtccagctggtacagtctggagctgaggtgaagaagcctggggcctcagtgaaggtctcctgcaaggcttctgg
ttacacctttaccagctacggtatcagctgggtgcgacaggcccctggacaagggcttgagtggatgggatggatcagcgcttacaatggtaac
acaaactatgcacagaagctccagggcagagtcaccatgaccacagacacatccacgagcacagcctacatggagctgaggagcctgagat
ctgacgacacggccgtgtattactgtgcgcgctggggtggtttcggtgctgttgatcattgggtcaaggtactctggtgaccgtctcctcaac
tagtggccaggccggccagcaccatcaccatcaccatggcgcatacccgtacgacgttccggactacgcttct [SEQ ID NO: 769]

Amino Acid Sequence
QSVVTQPPSVSVAPGKTARITCGGNNIGSKSVHWYQQKPGQAPVLVIYYDSDRPSGIPERFS
GSNSGNTATLTISRVEAGDEADYYCQVWDSSSDVVFGGGTKLTVLGSRGGGGSGGGGSG
GGGSLEMAEVQLVQSGAEVKKPGASVKVSCKASGYTFTSYGISWVRQAPGQGLEWMGW
ISAYNGNTNYAQKLQGRVTMTTDTSTSTAYMELRSLRSDDTAVYYCARWGGFGAVDHW
GQGTLVTVSSTSGQAGQHHHHHHGAYPYDVPDYAS [SEQ ID NO: 770]

TABLE 166

ET200-016
DNA Sequence
Tcttctgagctgactcaggaccctgctgtgtctgtggccttgggacagacagtcaagatcacgtgccaaggagacagcctcacagactaccat
gcaacctggtaccagcagaagccaggacaggcccctgtcgctgtcatctatgctacaaacaaccggccactgggatcccagaccgattctct
ggttccagttccggaaacacagcttctttgaccatcactggggctcaggcggaagatgaggctgactattactgtaattcccgggacagcggca
cggacgaagtgttattcggcggagggaccaagctgaccgtcctaggttctagaggtggtggtggtagcggcggcggcggctctggtggtggt
ggatccctcgagatggccgaggtgcagctggtggagactggggaggcctggtcaagcctggggggtccctgagactctcctgtgcagcct
ctggattcacctcagtagctatagcatgaactgggtccgccaggctccagggaaggggctggagtgggtctcatccattagtagtagtagtagt
tacatatactacgcagactcagtgaagggccgattcaccatctccagagacaacgccaagaactcactgtatctgcaaatgaacagcctgagag
ccgaggacacggccgtgtattactgtgcgcgcggtcagggttacgattactgggtcaaggtactctggtgaccgtctcctcaactagtggcca
ggccggccagcaccatcaccatcaccatggcgcatacccgtacgacgttccggactacgcttct [SEQ ID NO: 771]

Amino Acid Sequence
SSELTQDPAVSVALGQTVKITCQGDSLTDYHATWYQQKPGQAPVAVIYATNNRPTGIPDR
FSGSSSGNTASLTITGAQAEDEADYYCNSRDSGTDEVLFGGGTKLTVLGSRGGGGSGGGG
SGGGGSLEMAEVQLVETGGGLVKPGGSLRLSCAASGFTFSSYSMNWVRQAPGKGLEWVS
SISSSSYIYYADSVKGRFTISRDNAKNSLYLQMNSLRAEDTAVYYCARGQGYDYWGQGT
LVTVSSTSGQAGQHHHHHHGAYPYDVPDYAS [SEQ ID NO: 772]

TABLE 167

ET200-017
DNA Sequence
Tcctatgtgctgactcagccaccctcggtgtcagtggccccaggaaagacggccaggattacctgtgggggaaacaacattggaagtaaaag
tgtgcactggtaccagcagaagccaggccaggcccctgtgctggtcgtctatgatgatagcgaccggccctcagggatccctgagcgattctct
ggctccaactctgggaacacggccaccctgagcatcagcagggtcgaagccggggatgaggccgactattactgtcaggtgtgggatagtag
tagtgatcatactgtcttcggaactgggaccaaggtcaccgtcctaggttctagaggtggtggtggtagcggcggcggcggctctggtggtggt
ggatccctcgagatggcccaggtgcagctacagcagtggggcgcaggactgttgaagccttcggagaccctgtccctcacctgcgctgtctat
ggtgggtccttcagtggttactactggagctggatccgccagccccagggaaggggctggagtggattggggaaatcaatcatagtggaag
caccaactacaacccgtccctcaagagtcgagtcaccatatcagtagacacgtccaagaaccagttctccctgaagctgagctctgtgaccgcc
gcggacacggccgtgtattactgtgcgcgctactacccgggtatggatatgtgggtcaaggtactctggtgaccgtctcctcaactagtggcca
ggccggccagcaccatcaccatcaccatggcgcatacccgtacgacgttccggactacgcttct [SEQ ID NO: 773]

Amino Acid Sequence
SYVLTQPPSVSVAPGKTARITCGGNNIGSKSVHWYQQKPGQAPVLVVYDDSDRPSGIPERF
SGSNSGNTATLSISRVEAGDEADYYCQVWDSSSDHTVFGTGTKVTVLGSRGGGGSGGGGS
GGGGSLEMAQVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCARYYPGMDMWGQGTL
VTVSSTSGQAGQHHHHHHGAYPYDVPDYAS [SEQ ID NO: 774]

TABLE 168

ET200-018
DNA Sequence
Caggctgtgctgactcagccgccctcaacgtctgggaccccgggcagagggtcaccatctcttgttctggaagcagctccaacatcgggag
aaatggtgtaaactggtaccagcagctcccaggagcggccccaaagtcctcatctataatgataatcagcgaccctcagggggtccctgaccg
agtctctggctcccagtctggctcctcaggcaccctggccatcgatgggctccggtctgaggatgaggctgattattactgtgcggcatgggatg
acagcctgcatggtgtggtattcggcggagggaccaagctgaccgtcctaggttctagaggtggtggtggtagcggcggcggcggctctggt
ggtggtggatccctcgagatggcccaggtccagctggtacagtctggggctgaggtgaagaagcctggggcctcagtgaaggtctcctgcaa
ggtttccggatacaccctcaatgaattatccatgcactgggtgcgacaggctcctggaaagggcttgagtggatgggaggttttgatcctgaag
atggtgaaacaatctacgcacagaagttccagggcagagtcaccatgaccgaggacacatctacagacacagcctacatggagctgagcagc
ctgagatctgaggacactgccgtgtattactgtgcgcgcggtggttacggtgattcttggggtcaaggtactctggtgaccgtctcctcaacta
gtggccaggccggccagcaccatcaccatcaccatggcgcatacccgtacgacgttccggactacgcttct [SEQ ID NO: 775]

Amino Acid Sequence
QAVLTQPPSTSGTPGQRVTISCSGSSSNIGRNGVNWYQQLPGAAPKVLIYNDNQRPSGVPD
RVSGSQSGSSGTLAIDGLRSEDEADYYCAAWDDSLHGVVFGGGTKLTVLGSRGGGGSGG
GGSGGGGSLEMAQVQLVQSGAEVKKPGASVKVSCKVSGYTLNELSMHWVRQAPGKGLE
WMGGFDPEDGETIYAQKFQGRVTMTEDTSTDTAYMELSSLRSEDTAVYYCARGGYGDS
WGQGTLVTVSSTSGQAGQHHHHHHGAYPYDVPDYAS [SEQ ID NO: 776]

TABLE 169

ET200-019
DNA Sequence
Aattttatgctgactcagccccactctgtgtcggagtctccggggaagacggtaaccatctcctgcacccgcagcagtggcagcattgccagca
actatgtgcagtggtaccagcagcgcccgggcagtgccccaccactgtgatctatgaggataaccaaagaccctctgggtccctgatcggtt
ctctggctccatcgacagctcctccaactctgcctccctcaccatctctggactgaagactgaggacgaggctgactactactgtcagtctta
tgatagcagcaattcttgggtgttcggcggagggaccaagctgaccgtcctaggttctagaggtggtggtggtagcggcggcggcggctctggtg
gtggtggatccctcgagatggcccaggtgcagctggtgcaatctggggctgaggtgaagaggcctgggtcctcggtgaaggtctcctgcacggc
ttctggaggcaccttcagcagcgatgctatcagctgggtgcgacaggcccctggacaagggcttgagtggatgggaggaatcatccctatgttt
ggtacagcaaactacgcacagaagttccagggcagagtcacgattaccgcggacgaatccacgagcacagcctacatggagctgagcagcc
tgagatctgaggacacggccgtgtattactgtgcgcgcgaaggttactactacccgtctgcttacctgggttctgttctgaacgacatctc
ttctgtttacgatgaatggggtcaaggtactctggtgaccgtctcctcaactagtggccaggccggccagcaccatcaccatcaccatgg
cgcatacccgtacgacgttccggactacgcttct [SEQ ID NO: 777]

Amino Acid Sequence
NFMLTQPHSVSESPGKTVTISCTRSSGSIASNYVQWYQQRPGSAPTTVIYEDNQRPSGVPDR
FSGSIDSSSNSASLTISGLKTEDEADYYCQSYDSSNSWVFGGGTKLTVLGSRGGGGSGGGG
SGGGGSLEMAQVQLVQSGAEVKRPGSSVKVSCTASGGTFSSDAISWVRQAPGQGLEWMG
GIIPMFGTANYAQKFQGRVTITADESTSTAYMELSSLRSEDTAVYYCAREGYYYPSAYLGS
VLNDISSVYDEWGQGTLVTVSSTSGQAGQHHHHHHGAYPYDVPDYAS [SEQ ID NO: 778]

TABLE 170

ET200-020
DNA Sequence
Cagtctgtcgtgacgcagccgccctcagtgtctgcggccccaggacagaaggtcaccatctcctgctctggaagcacctccaacattggaaat
aatgatgtatcctggtaccagcagctcccaggaacagcccccaaactcctcatttatgacaataataagcgaccctcagggattcctgaccgat
ctctggctccaagtctggcacgtcagccaccctgggcatcaccggactccagactggggacgaggccgattattactgcggaacatgggatag
cagcgtgagtgcttcttgggtcttcggcagagggaccaagctgaccgtcctaggtctagaggtggtggtggtagcggcggcggcggctctgg
tggtggtggatccctcgagatggcccaggtgcagctggtgcagtctggagctgaggtgaagaagcctggggcctcagtgaaggtctcctgca
aggcttctggttacacctttaccagctatggtatcagctgggtgcgacaggcccctggacaagggcttgagtggatgggatggatcagcgctta
caatggtaacacaaactatccacagaagctccagggcagagtcaccatgaccaccgacacatccacgagcacagcctacatggagctgagg
agcctgagatctgacgacacgccgtgtattactgtgcgcgctctatgacttctttcgattactgggtcaaggtactctggtgaccgtctcctc
aactagtggccaggccggccagcaccatcaccatcaccatggcgcataccgtacgacgttccggactacgcttct [SEQ ID NO: 779]

Amino Acid Sequence
QSVVTQPPSVSAAPGQKVTISCSGSTSNIGNNDVSWYQQLPGTAPKLLIYDNNKRPSGIPDR
FSGSKSGTSATLGITGLQTGDEADYYCGTWDSSVSASWVFGRGTKLTVLGSRGGGSGGG
GSGGGGSLEMAQVQLVQSGAEVKKPGASVKVSCKASGYTFTSYGISWVRQAPGQGLEW
MGWISAYNGNTNYPQKLQGRVTMTTDPSTSTAYMELRSLRSDDTAVYYCARSMTSFDY
WGQGTLVTVSSTSGQAGQHHHHHHGAYPYDVPDYAS [SEQ ID NO: 780]

TABLE 171

ET200-021
DNA Sequence
Cagtctgtgttgacgcagccgccctcagtgtctgcggccccaggacagaaggtcaccatctcctgctctggaagcaactccaacattgggaat
aattatgtatcctggtatcagcaactcccaggacagccccaaactcctcatttatgacaataataagcgaccctcagggattcctgaccgatt
ctctggctccaggtctggcacgtcagccaccctgggcatcaccgactccagactggggacgaggccgattattactgcggaacatggaataccc
actgtgactcctggctatgtcttcggaactgggaccaaggtcaccgtcctaggttctagaggtggtggtggtagcggcggcggcggctctggtg
gtggtggatccctcgagatggccgaagtgcagctggtgcagtctggagctgaggtgaagaagcctggggcctcagtgaaggtctcctgcaag
gcttctggttacacctttaccagctatggtatcagctgggtgcgacaggcccctggacaagggcttgagtggatgggatggatcagcgcttacaa
tggtaacacaaactatgcacagaagctccagggcagagtcaccatgaccaccgacacatccacgagcacagcctacatggagctgagga
gcctgagatctgacgacaccgccatgtattactgtgcgcgctctgtttacgacctggatacttgggtcaaggtactctggtgaccgtctcctca
actagtggccaggccggccagcaccatcaccatcaccatggcgcataccgtacgacgttccggactacgcttct [SEQ ID NO: 781]

Amino Acid Sequence
QSVLTQPPSVSAAPGQKVTISCSGSNSNIGNNYVSWYQQLPGTAPKLLIYDNNKRPSGIPDR
FSGSRSGTSATLGITGLQTGDEADYYCGTWNTTVTPGYVFGTGTKVTVLGSRGGGSGGG
GSGGGGSLEMAEVQLVQSGAEVKKPGASVKVSCKASGYTFTSYGISWVRQAPGQGLEW
MGWISAYNGNTNYAQKLQGRVTMTTDTSTSTAYMELRSLRSDDTAMYYCARSVYDLDT
WGQGTLVTVSSTSGQAGQHHHHHHGAYPYDVPDYAS [SEQ ID NO: 782]

TABLE 172

ET200-022
DNA Sequence
cagtctgtcgtgacgcagccgccctcagtgtctgcggccccaggacagaaggtcaccatctcctgctctggaagcagctccaacattgggaat aattatgtatcctggtaccagcagctcccaggaacagcccccaaactcctcatttatgacaataataagcgaccctcagggattcctgaccgatt ctctggctccaagtctggcacgtcagccaccctgggcatcaccggactccagactggggacgaggccgattattactgcggaacatgggatagc agcctgggggccccttatgtcttcggaactgggaccaaggtcaccgtcctaggttctagaggtggtggtggtagcggcggcggcggctctggt ggtggtggatccctcgagatggccgaggtgcagctggtgcagtcttggggaggctcggaacagcctggcaggtccctgagactctcctgtgc agcctctggattcacctttgatgattatgccatgcactgggtccggcaagctccagggaagggcctggagtgggtctcaggtattagttggaata gcggtagcataggctatgcggactctgtgaagggccgattcaccatctcagagacaacgccaagaattccctgtatctgcaaatgaacagtct gagagctgaggacaccgccatgtattactgtgcgcgctaccgtcaggttggttctgcttacgattcttgggtcaaggtactctggtgaccgtct cctcaactagtggccaggccggccagcaccatcaccatcaccatggcgcataccgtacgacgttccggactacgcttct [SEQ ID NO:
783]

Amino Acid Sequence
QSVVTQPPSVSAAPGQKVTISCSGSSSNIGNNYVSWYQQLPGTAPKLLIYDNNKRPSGIPDR
FSGSKSGTSATLGITGLQTGDEADYYCGTWDSSLGAPYVFGTGTKVTVLGSRGGGSGGG
GSGGGGSLEMAEVQLVQSWGGSEQPGRSLRLSCAASGFTFDDYAMHWVRQAPGKGLEW
VSGISWNSGSIGYADSVKGRFTISRDNAKNSLYLQMNSLRAEDTAMYYCARYRQVGSAY
DSWGQGTLVTVSSTSGQAGQHHHHHHGAYPYDVPDYAS [SEQ ID NO: 784]

TABLE 173

ET200-023
DNA Sequence
ctgcctgtgctgactcagccaccctcggtgtcagtggccccaggaaagacggccaggattacctgtgggggaaacaacattggaagtaaaagt
gtgcactggtatcagcagaagccaggccaggcccctgtgctggtcgtctatgctgatagcgaccggccctcagggatccctgagcgattctctg
gctccaactctgggaacacggccaccatcagcagggtcgaagccggggatggagatgctgactattactgtcaggtgtgggatagtagt
agttatcataattatgtcttcggaactgggaccaaggtcaccgtcctaggttctagaggtggtggtggtagcggcggcggcggctctggtggtgg
tggatccctcgagatggccgaggtgcagctggtgcagtctggagctgaggtgaagaagcctggggcctcagtgaaggtctcctgcaaggctt
ctggttacacctttaccagctatggtatcagctgggtgcgacaggcccctggacaagggcttgagtggatgggatggatcagcgcttacaatgg
taacacaaactatgcacagaagctccagggcagagtcaccatgaccacagacacatccacgagcacagcctacatggagctgagcagcctg
agatctgaggacaccgccatgtattactgtgcgcgctactggggtttcggtgtttctgatcgttggggtcaaggtactctggtgaccgtctcctc
aactagtggccaggccggccagcaccatcaccatcaccatggcgcatacccgtacgacgttccggactacgcttct [SEQ ID NO: 785]

Amino Acid Sequence
LPVLTQPPSVSVAPGKTARITCGGNNIGSKSVHWYQQKPGQAPVLVVYADSRPSGIPERF
SGSNSGNTATLTISRVEAGDEADYYCQVWDSSSYHNYVFGTGTKVTVLGSRGGGGSGGG
GSGGGGSLEMAEVQLVQSGAEVKKPGASVKVSCKASGYTFTSYGISWVRQAPGQGLEW
MGWISAYNGNTNYAQKLQGRVTMTTDTSTSTAYMELSSLRSEDTAMYYCARYWGFGVS
DRWGQGTLVTVSSTSGQAGQHHHHHHGAYPYDVPDYAS [SEQ ID NO: 786]

TABLE 174

ET200-024
DNA Sequence
aattttatgctgactcagccccactctgtgtcggagtctccggggaagacggtaaccatctcctgcaccggcagcagtggcagcattgccagca
actatgtgcagtggtaccagcagcgcccgggcagtgcccccaccactgtgatctatgaggataaccaaagaccctctggggtccccgatcggt
tctctggctccatcgacagctcctccaactctgcctccctccaccatctctggactgaagactgaggagcaggctgactactactgtcagtcttat
gacagcagcaatctttgggtgttcggcggagggaccaagctgaccgtcctaggttctagaggtggtggtggtagcggcggcggcggctctggtg
gtggtggatccctcgagatggcccagatgcagctggtgcagtctggggctgaggtgaagaagcctgggtcctcggtgaaggtctcctgcaag
gcttctggaggcaccttcagcagctatgctatcagctgggtgcgacaggcccctggacaagggcttgagtggatgggagggatcatccctatct
ttggtacagcaaactacgcacagaagttccagggcagagtcaccattaccgcggacgaatccacgagcacagcctacatggagctgagcag
cctgagatctgaggacactgccgtgtattactgtgcgcgctacaactactactactacgattcttgggtcaaggtactctggtgaccgtctcct
caactagtggccaggccggccagcaccatcaccatcaccatggcgcatacccgtacgacgttccggactacgcttct [SEQ ID NO: 787]

Amino Acid Sequence
NFMLTQPHSVSESPGKTVTISCTGSSGSIASNYVQWYQQRPGSAPTTVIYEDNQRPSGVPDR
FSGSIDSSNSASLTISGLKTEDEADYYCQSYDSSNLWVFGGGTKLTVLGSRGGGGSGGGG
SGGGGSLEMAQMQLVQSGAEVKKPGSSVKVSCKASGGTFSSYAISWVRQAPGQGLEWM
GGIIPIFGTANYAQKFQGRVTITADESTSTAYMELSSLRSEDTAVYYCARYNYYYDSWGQ
GTLVTVSSTSGQAGQHHHHHHGAYPYDVPDYAS [SEQ ID NO: 788]

TABLE 175

ET200-025
DNA Sequence
gacatccagatgacccagtctccatcctccctgtctgcatctgtaggagacagagtcaccatcacttgccgggcaagtcagagcattagcagcta tttaaattggtatcagcagaaaccagggaaagcccctaagctcctgatctatgctgcatccagtttgcaaagtggggtcccatcaaggttcagt ggcagtggatctgggacagatttcactctcaccatcagcagtctgcaacctgaagattttgcaacttactactgtcaacagagttacagtacccc attcactttcggccctgggaccaaagtggatatcaaacgttctagaggtggtggtggtagcggcggcggcggctctggtggtggtggatcctcg agatggccgaggtgcagctggtgcagtctggggctgaggtgaagaagcctgggtcctcggtgaaggtctcctgcaaggcttctggaggcacctt cagcagctatgctatcagctgggtgcgacaggcccctggacaagggcttgagtggatgggagggatcatccctatctttggtacagcaaactac gcacagaagttccagggcagagtcacgattaccgcggacgaatccacgagcacagcctacatggagctgagcagcctgagatctgaggaca ccgccatgtattactgtgcgcgctactggggttacgactcttacgatgaatggggtcaaggtactctggtgaccgtctcctcaactagtggcca ggccggccagcaccatcaccatcaccatggcgcatacccgtacgacgttccggactacgcttct [SEQ ID NO: 789]

Amino Acid Sequence
DIQMTQSPSSLSASVGDRVTITCRASQSISSYLNWYQQKPGKAPKLLIYAASSLQSGVPSRF
SGSGSGTDFTLTISSLQPEDFATYYCQQSYSTPFTFGPGTKVDIKRSRGGGGSGGGGSGGGG
SLEMAEVQLVQSGAEVKKPGSSVKVSCKASGGTFSSYAISWVRQAPGQGLEWMGGIIPIFG
TANYAQKFQGRVTITADESTSTAYMELSSLRSEDTAMYYCARYWGYDSYDEWGQGTLVT
VSSTSGQAGQHHHHHHGAYPYDVPDYAS [SEQ ID NO: 790]

TABLE 176

ET200-026
DNA Sequence
aattttatgctgactcagcccactctgtgtcggagtctccggggaagacggtaaccatctcctgcaccggcagcagtggcagcattgccagca
actatgtgcagtggtaccagcagcgcccgggcagtgcccccaccactgtgatctatgaggataaccaaagaccctctggggtccctgatcggtt
ctctggctccatcgacagctcctccaactctgcctccctcaccatctctggactgaagactgaggacgaggctgactactactgtcagtcttatg
atagcagcaattgggtgttcggcggagggaccaagctgaccgtcctaggtctagaggtggtggtggtagcggcggcggcggctctggtggtgg
tggatccctcgagatggccgaggtccagctggtgcagtctggggctgaggtgaagaagcctgggtcctcggtgaaggtctcctgcaaggcttc
tggaggcaccttcagcagctatgctatcagctgggtgcgacaggcccctggacaagggcttgagtggatgggagggatcatccctatctttggt
acagcaaactacgcacagaagttccagggcagagtcacgattaccgccgacgaatccacgagcacagcctacatggagctgagcagcctga
gatctgaggacacggccgtgtattactgtgcgcgcaacaaccattactacaacgattactgggtcaaggtactctggtgaccgtctcctcaact
agtggccaggccggccagcaccatcaccatcaccatggcgcataccgtacgacgttccggactacgcttct [SEQ ID NO: 791]

Amino Acid Sequence
NFMLTQPHSVSESPGKTVTISCTGSSGSIASNYVQWYQQRPGSAPTTVIYEDNQRPSGVPDR
FSGSIDSSNSASLTISGLKTEDEADYYCQSYDSSNWVFGGGTKLTVLGSRGGGGSGGGGS
GGGGSLEMAEVQLVQSGAEVKKPGSSVKVSCKASGGTFSSYAISWVRQAPGQGLEWMGG
IIPIFGTANYAQKFQGRVTITADESTSTAYMELSSLRSEDTAVYYCARNNHYYNDYWGQGT
LVTVSSTSGQAGQHHHHHHGAYPYDVPDYAS [SEQ ID NO: 792]

TABLE 177

ET200-027
DNA Sequence
cagtctgtgttgacgcagccgccctcagtgtctggggcccagggcaggggtcaccatccctgcactgggagcagctccaacatcggggg
caggttatgatgtacactggtaccagcagcttccaggacagccccccaaactcctcatctatggtaacaacaatcggccctcaggggtccctga
ccgcttctctggctccaggtctgtggctccctcagcctccctggccaggctgaggatgaggctgattattactgccagtcctat
gacagcagcctgagtgatgtggtattcggcggagggaccaaggtcaccgtcctaggtctagaggtggtggtggtagcggcggcggcggctctg
gtggtggtggatccctcgagatggccgaggtccagctggtgcagtctggggctgaggtgaagaagcctggggctacagtgaaaatctcctgc
aaggtttctggatacaccttcaccgactactacatgcactgggtgcaacaggcccctggaaaagggcttgagtggatgggacttgttgatcctga
agatggtgaaacaatatacgcagagaagttccagggcagagtcaccatcacagacacagcctacatggagctgagca
gcctgagatctgaggacacggccgtgtattactgtgcgcgctactggtcttactcttcgactacctgtacatgccggaaggtaacgattggtg
gggtcaaggtactctggtgaccgtctcctcaactagtggccaggccggccagcaccatcaccatcaccatggcgcataccgtacgacgttccgg
actacgcttct [SEQ ID NO: 793]

Amino Acid Sequence
QSVLTQPPSVSGAPGQGVTIPCTGSSSNIGAGYDVHWYQQLPGTAPKLLIYGNNNRPSGVP
DRFSGSRSGSSASLAITGLQAEDEADYYCQSYDSSLSDVVFGGGTKVTVLGSRGGGGSGG
GGSGGGGSLEMAEVQLVQSGAEVKKPGATVKISCKVSGYTFTDYYMHWVQQAPGKGLE
WMGLVDPEDGETIYAEKFQGRVTITADTSTDTAYMELSSLRSEDTAVYYCARYWSYSFDY
LYMPEGNDWWGQGTLVTVSSTSGQAGQHHHHHHGAYPYDVPDYAS [SEQ ID NO: 794]

TABLE 178

ET200-028
DNA Sequence
cagtctgtgttgactcagccacccgcagcgtctgggaccccggacagagagtcaccatctcttgttctggggggcgtctccaacatcgggagtg
gtgctctaaattggtaccagcaactcccaggaacggccccccaaactcctcatctatagttacaatcagcggccctcaggggtctctgaccgatt
ctctggctccaggtctgccacctcagcctccctggccatcagtgggctccagtctgaggatgaggctgattattactgtgcaacctgggatgata
gtgtgaatggtgggtgttcggcggagggaccaagctgaccgtcctaggttctagaggtggtggtggtagcggcggcggcggctctggtggtgg
tggatccctcgagatggcccaggtccagctggtacagtctggagctgaggtgaagaagcctggggattcagtgaaggtctcctgcaagcttct
ggttacaattttctcaactatggtatcaactgggtgcgacaggcccctggacaagggcttgagtggatgggatggattagcacttacaccggtaa
cacaaactatgcacagaagctgcagggcagagtcaccttcaccacagacacatccacgagcacagcctacatggagatgaggagcctgaga
tctgacgacacggccgtgtattactgtgcgcgcgacctgtactacgaaggtgttgattactgggtcaaggtactctggtgaccgtctcct
caactagtggccaggccggccagcaccatcaccatcaccatggcgcataccgtacgacgttccggactacgcttct [SEQ ID NO: 795]

Amino Acid Sequence
QSVLTQPPAASGTPGQRVTISCSGGVSNIGSGALNWYQQLPGTAPKLLIYSYNQRPSGVSD
RFSGSRSATSASLAISGLQSEDEADYYCATWDDSVNGWVFGGGTKLTVLGSRGGGGSGG
GGSGGGGSLEMAQVQLVQSGAEVKKPGDSVKVSCKPSGYNFLNYGINWVRQAPGQGLE
WMGWISTYTGNTNYAQKLQGRVTFTTDTSTSTAYMEMRSLRSDDTAVYYCARDLYYYE
GVDYWGQGTLVTVSSTSGQAGQHHHHHHGAYPYDVPDYAS [SEQ ID NO: 796]

TABLE 179

ET200-029
DNA Sequence
caggctgtgctgactcagccaccctcagtgtcagtggccccaggaaagacggccagggttacctgtgggggaaacaacattggaagtgaaag
tgtgcactggtaccagcagaagccaggccaggcccctgtgttggtcatctattatgataccgaccggccctcagggatccctgagcgattctctg
gctcccactctgggaccacggccaccctgaccatcagcagggtcgaagccggggatgaggccgactattactgtcaggtgtgggatagtagt
agggatcatgtggtattcggcggagggaccaagctgaccgtcctaggttctagaggtggtggtggtagcggcggcggcggctctggtggtgg
tggatccctcgagatggcccaggtgcagctggtgcagtctggggaggcgtggtccagcctggggaggtccctgagactcctgtgcggcct
ctggattcaccttcagtagctatgctatgcactgggtccgccaggctccaggcaagggactggagtgggtggcagttatatcatatgatggaagc
aataaatactacgcagactccgtgaagggccgtattcaccatctccagagacaattccaagaacacgctgtatctgcaaatgaacagcctgagag
ctgaggacacggccgtgtattactgtgcgcgctcttacttcacttctggtttctacgattactgggtcaaggtactctggtgaccgtctcctc
aactagtggccaggccggccagcaccatcaccatcaccatggcgcatacccgtacgacgttccggactacgcttct [SEQ ID NO: 797]

Amino Acid Sequence
QAVLTQPPSVSVAPGKTARVTCGGNNIGSESVHWYQQKPGQAPVLVIYYDTDRPSGIPERF
SGSHSGTTATLTISRVEAGDEADYYCQVWDSSRDHVVFGGGTKLTVLGSRGGGGSGGGG
SGGGGSLEMAQVQLVQSGGGVVQPGRSLRLSCAASGFTFSSYAMHWVRQAPGKGLEWV
AVISYDGSNKYYADSVKGLFTISRDNSKNTLYLQMNSLRAEDTAVYYCARSYFTSGFYDY
WGQGTLVTVSSTSGQAGQHHHHHHGAYPYDVPDYAS [SEQ ID NO: 798]

TABLE 180

ET200-030
DNA Sequence
cagtctgtcgtgacgcagccgccctcagtgtctggggccccagggcagagggtcaccatctcctgcactgggagcagttccaacatcggggc
aggttatgatgtaaattggtatcagcagtttccaggaacagcccccaaactcctcatctatggtaacagcaatcggccctcaggggtccctgacc
gattctctggctccaagtctggcacctcagcctccctggccatcactggcctccaggctgaggatgaggctgactattactgccagtcctatga
cagcagcctgagtggctcttatgtcttcggaactgggaccaaggtcaccgtcctaggttctagaggtggtggtggtagcggcggcggcggctctg
gtggtggtggatccctcgagatggcccagatgcagctggtgcagtctggggctgaggtgaagaagcctggggcctcagtgaaggtctcctgc
aaggcttccggatacaccctcactgaattatccatgcactgggtgcgacaggctcctggaaaagggcttgagtggatgggaggttttgatcctga
agatggtgaaacaatctacgcacagaagttccagggcagagtcaccatgaccgaggacacatctacagacacagcctacatggagctgagca
gcctgagatctgaggacactgccgtgtattactgtgcgcgcatgtcttctatgtactacgattgggtcaaggtactctggtgaccgtctcct
caactagtggccaggccggccagcaccatcaccatcaccatggcgcatacccgtacgacgttccggactacgcttct [SEQ ID NO: 799]

Amino Acid Sequence
QSVVTQPPSVSGAPGQRVTISCTGSSSNIGAGYDVNWYQQFPGTAPKLLIYGNSNRPSGVP
DRFSGSKSGTSASLAITGLQAEDEADYYCQSYDSSLSGSYVFGTGTKVTVLGSRGGGGSGG
GGSGGGGSLEMAQMQLVQSGAEVKKPGASVKVSCKASGYTLTELSMHWVRQAPGKGLE
WMGGFDPEDGETIYAQKFQGRVTMTEDTSTDTAYMELSSLRSEDTAVYYCARMSSMYYD
WGQGTLVTVSSTSGQAGQHHHHHHGAYPYDVPDYAS [SEQ ID NO: 800]

TABLE 181

ET200-031
DNA Sequence
tcctatgtgctgactcagccaccctcagtgtcagtggccccaggaaagacggccaggattacctgtgggggaaacaacattggaagtaaaagt
gtgcactggtaccagcagaagccaggccaggcccctgtgctggtcatctattatgatagcgaccggccctcagggatccctgagcgattctctg
gctccaactctgggaacacggccaccctgaccatcagcagggtcgaagccggggatgaggccgactattactgtcaggtgtgggatagtagt
agtgattatgtcttcggaactgggaccaaggtcaccgtcctaggttctagaggtggtggtggtagcggcggcggcggctctggtggtggtggat
ccctcgagatggccgaggtgcagctggtggagactggggggaggcttggtcaagcctggagggtccctgagactctcctgtgcagcctctgga
ttcaccgtcagtgactactacatgagctggatccgccaggctccagggaagggcctggagtggatttcatacattagtggtagtggtaatagcat
atactacgcagactctgtgaagggccgattcaccatctccagggacaacgccaagaactcactggatctgcaaatgaccagcctgagagccga
ggacacggccgtatattactgtgcgcgctctactaaattcgattactgggtcaaggtactctggtgaccgtctcctcaactagtggccaggccg
gccagcaccatcaccatcaccatggcgcatacccgtacgacgttccggactacgcttct [SEQ ID NO: 801]

Amino Acid Sequence
SYVLTQPPSVSVAPGKTARITCGGNNIGSKSVHWYQQKPGQAPVLVIYYDSDRPSGIPERFS
GSNSGNTATLTISRVEAGDEADYYCQVWDSSSDYVFGTGTKVTVLGSRGGGGSGGGGSG
GGGSLEMAEVQLVETGGGLVKPGGSLRLSCAASGFTVSDYYMSWIRQAPGKGLEWISYIS
GSGNSIYYADSVKGRFTISRDNAKNSLDLQMTSLRAEDTAVYYCARSTKFDYWGQGTLVT
VSSTSGQAGQHHHHHHGAYPYDVPDYAS [SEQ ID NO: 802]

TABLE 182

ET200-032
DNA Sequence
ctgcctgtgctgactcagccaccctcagcgtctgggaccccggggcagagggtcaccatctcttgttctggaagcagctccaacgtcggaagtt
acactgtaaactggtaccggcagctcccaggaacggcccccacactcctcatctataataataatcagcggccctcaggggtccctgaccgatt
ctctgactccaagtctggcacctcggcctccctgaccattagtgggctccagcctgaggatgaggctgattattattgtgcagcatgggatgaca
ggctgggtggttatgtcttcggaactgggaccaaggtcaccgtcctaggttctagaggtggtggtggtagcggcggcggcggctctggtggtg
gtggatccctcgagatggccgaggtgcagctggtgcagtctggagcagaggtgaaaaagccgggggagtctctgaagatctcctgtaagggt
tctggatacagctttaccaactactggatcggctgggtgcgccagatgcccgggaaaggcctggagtggatggggatcatctatcctggtgact
ctgataccagatacagcccgtccttccaaggccaggtcaccatctcagccgacaagtccatcagcaccgcctacctacagtggagcagcctga
aggcctcggacaccgccatgtattactgtgcgcgctctactggttcttctcatatgtctgatgaatggggtcaaggtactctggtgaccgtctcc
tcaactagtggccaggccggccagcaccatcaccatcaccatggcgcatacccgtacgacgttccggactacgcttct [SEQ ID NO: 803]

Amino Acid Sequence
LPVLTQPPSASGTPGQRVTISCSGSSSNVGSYTVNWYRQLPGTAPTLLIYNNNQRPSGVPDR
FSDSKSGTSASLTISGLQPEDEADYYCAAWDDRLGGYVFGTGTKVTVLGSRGGGGSGGGG
SGGGGSLEMAEVQLVQSGAEVKKPGESLKISCKGSGYSFTNYWIGWVRQMPGKGLEWM
GIIYPGDSDTRYSPSFQGQVTISADKSISTAYLQWSSLKASDTAMYYCARSTGSSHMSDEW
GQGTLVTVSSTSGQAGQHHHHHHGAYPYDVPDYAS [SEQ ID NO: 804]

TABLE 183

ET200-033
DNA Sequence
aattttatgctgactcagccccactctgtgtcggagtctccggggaagacggtaaccatctcctgcaccggcagcagtggcagcattgccagca
actatgtgcagtggtaccagcagcgccccgggcagtgccccccaccactgtgatctatgaggataaccaaagaccctctgggtccctgatcggtt
ctctggctccatcgacagctcctccaactctgcctcctcaccatctctggactgaagactgaggacgaggctgactactactgtcagtcttatg
atagcagcaatcattgggtgttcggcggagggaccaagctgaccgtcctaggttctagaggtggtggtggtagcggcggcggcggctctggtgg
tggtggatccctcgagatggcccaagtgcagctacagcagtgggcgcaggactgttgaagcttcggagaccctgtccctcacctgcgctgt
ctatggtgggtccttcagtggttactactggagctggatctgccagcccccagggaagggctggagtggattgggagatcactcatagtgg
aagtccaactacaacccgtccctcaagagtcgagtcaccatatcagtagacacgtccaagaaccagttctccctgaagctgagctctgtgacc
gccgcggacacggccgtgtattactgtgcgcgctcttctatcatgtctgattactggggtcaaggtactctggtgaccgtctcctcaactagtg
gccaggccggccagcaccatcaccatcaccatggcgcatacccgtacgacgttccggactacgcttct [SEQ ID NO: 805]

Amino Acid Sequence
NFMLTQPHSVSESPGKTVTISCTGSSGSIASNYVQWYQQRPGSAPTTVIYEDNQRPSGVPDR
FSGSIDSSSNSASLTISGLKTEDEADYYCQSYDSSNHWVFGGGTKLTVLGSRGGGGSGGGG
SGGGGSLEMAQVQLQQWGAGLLKPSETLSLTCAVYGGSFSGYYWSWIRQPPGKGLEWIG
EITHSGRSNYNPSLKSRVTISVDTSKNQFSLKLSSVTAADTAVYYCARSSIMSDYWGQGTL
VTVSSTSGQAGQHHHHHHGAYPYDVPDYAS [SEQ ID NO: 806]

TABLE 184

ET200-034
DNA Sequence
cagtctgtgttgacgcagccgccctcagtgtctggggccccagggcagagggtcaccatctcctgcactgggagcacctccaacatcggggc
aggttatgatgtacactggtaccagcagcttccaggaacagccccaaactcctcatcaacaataacaggaatcggcctcaggggtccctgac
cgattctctggctccaagtctggcacgtcagccaccctgggcatcaccgactccagactggggacgaggccgattattactgcggaacatgg
gatggcagcctgactggtgcagtgttcggcggagggaccaagctgaccgtcctaggttctagaggtggtggtggtagcggcggcggcggct
ctggtggtggtggatccctcgagatggccgaggtccagctggtgcagtctggggctgaggtgaagaagcctgggtcctcggtgaaggtctcat
gcaaggcttctggaggcaccttcagcagctatgctatcagctgggtgcgacaggcccctggacaagggcttgagtggatggggagggatcatc
cctatctttggtacagcaaactacgcacagaagttccagggcagagtcacgattaccgcggacgaatccacgagcacagcctacatggagctg
agcagcctgagatctgaggacacggccgtgtattactgtgcgcgcggttctgctctggaccattacgatcgttggggtcaaggtactctggtgac
cgtctcctcaactagtggccaggccggccagcaccatcaccatcaccatggcgcatacccgtacgacgttccggactacgcttct [SEQ ID
NO: 807]

Amino Acid Sequence
QSVLTQPPSVSGAPGQRVTISCTGSTSNIGAGYDVHWYQQLPGTAPKLLINNNRNRPSGVP
DRFSGSKSGTSATLGITGLQTGDEADYYCGTWDGSLTGAVFGGGTKLTVLGSRGGGGSGG
GGSGGGGSLEMAEVQLVQSGAEVKKPGSSVKVSCKASGGTFSSYAISWVRQAPGQGLEW
MGGIIPIFGTANYAQKFQGRVTITADESTSTAYMELSSLRSEDTAVYYCARGSALDHYDRW
GQGTLVTVSSTSGQAGQHHHHHHGAYPYDVPDYAS [SEQ ID NO: 808]

TABLE 185

ET200-035
DNA Sequence
aattttatgctgactcagcccactctgtgtcggagtctccggggaagacggtaaccatctcctgcacccgcagcagtggcagcattgccagca
actatgtgcagtggtaccagcagcgcccgggcagtgccccaccactgtgatctatgaggataaccaaagaccctctggggtccctgatcggtt
ctctggctccatcgacagctcctccaactctgcctccctcaccatctctggactcagaactgaggacgaggctgactactactgtcagtcttatgat
agcaccaattgggtgttcggcggagggaccaagctgaccgtcctaggttctagaggtggtggtggtagcggcggcggcggctctggtggtgg
tggatccctcgagatggcccaggtgcagctggtgcagtctggggctgaggtgaagaagcctgggtcctcggtgaaggtctcctgcaaggcttc
tggaggcaccttcagcagctatgctatcagctgggtgcgacaggcccctggacaagggcttgagtggatgggagggatcatccctatctttggt
acagcaaactacgcacagaagttccagggcagagtcacgattaccgcggacgaatccacgagcacagcctacatggagctgagcagcctga
gatctgaggacactgccgtgtattactgtgcgcgctacaactactacttcaacgattactggggtcaaggtactctggtgaccgtctcctcaactag
tggccaggccgccagcaccatcaccatcaccatggcgcataccgtacgacgttccggactacgcttct [SEQ ID NO: 809]

Amino Acid Sequence
NFMLTQPHSVSESPGKTVTISCTRSSGSIASNYVQWYQQRPGSAPTTVIYEDNQRPSGVPDR
FSGSIDSSSNSASLTISGLKTEDEADYYCQSYDSTNWVFGGGTKLTVLGSRGGGGSGGGGS
GGGGSLEMAQVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARYNYYFNDYWGQG
TLVTVSSTSGQAGQHHHHHHGAYPYDVPDYAS [SEQ ID NO: 810]

TABLE 186

ET200-037
DNA Sequence
tcctatgtgctgactcagccaccctcagtgtcagtggccccaggaaagacggccaggattacctgtgggggaaacaacattggaagtaaaagt
gtgcactggtaccagcagaagccaggccaggcccctgtgctggtcatctattatgatagcgaccggccctcagggatccctgagcgattctctg
gctccaactctgggaacacggccaccctgaccatcagcagggtcgaaggccgactattactgtcaggtgtggggatagtagt
agtgatcatccttatgtcttcggaactgggaccaagctcaccgtcctaggttctagaggtggtggtggtagcggcggcggcggctctggtggtg
gtggatccctcgagatggcccagatgcagctggtgcagtctggagctgaggtgaagaagcctggggcctcagtgaaggtctcctgcaaggctt
ctggttacacctttaccagctatggtatcagctgggtgcgacaggcccctggacaagggcttgagtggatgggatggatcagcgcttacaatgg
taacacaaactatgcacagaagctccagggcagagtcaccatgaccacagacacatccacggcacagcctacatggagctgaggagcctg
agatctgacgacactgccgtgtattactgtgcgcgctctatgttcggtgctcatgattcttggggtcaaggtactctggtgaccgtctcctcaactag
tggccaggccgccagcaccatcaccatcaccatggcgcataccgtacgacgttccggactacgcttct [SEQ ID NO: 811]

Amino Acid Sequence
SYVLTQPPSVSVAPGKTARITCGGNNIGSKSVHWYQQKPGQAPVLVIYYDSDRPSGIPERFS
GSNSGNTATLTISRVEAGDEADYYCQVWDSSSDHPYVFGTGTKVTVLGSRGGGGSGGGG
SGGGGSLEMAQMQLVQSGAEVKKPGASVKVSCKASGYTFTSYGISWVRQAPGQGLEWM
GWISAYNGNTNYAQKLQGRVTMTTDTSTSTAYMELRSLRSDDTAVYYCARSMFGAHDS
WGQGTLVTVSSTSGQAGQHHHHHHGAYPYDVPDYAS [SEQ ID NO: 812]

TABLE 187

ET200-038
DNA Sequence
cagtctgtgttgacgcagccgccctcagtgtctggggccccagggcagagggtcaccatctcctgcactgggagcagctccaacatcggggc
aggttttgatgtacactggtaccagctacttccaggaacagcccccaaactcctcatctatgctaacagcaatcggccctcaggggtccctgacc
gattctctggctccaagtctggcacctcagcctcctggccatcactgggctcctggctgaggatgaggctgattattactgccagtcctatgaca
gcagcctgagtggtgtggtattcggcggagggaccaagctgaccgtcctaggttctagaggtggtggtggtagcggcggcggcggctctggt
ggtggtggatccctcgagatggcccaggtgcagctggtgcaatctggggctgaggtgaagaagcctgggtcctcggtgaaggtctcctgcaa
ggcttctggaggcaccttcagcagctatgctatcagctgggtgcgacaggcccctggacaagggcttgagtggatgggagggatcatccctat
ctttggtacagcaaactacgcacagaagttccagggcagagtcacgattaccgcggacgaatccacgagcacagcctacatggagctgagca
gcctgagatctgaggacactgccgtgtattactgtgcgcgcggtgcttcttttcgaccgtcatgataactggggtcaaggtactctggtgaccgtct
cctcaactagtggccaggccgccagcaccatcaccatcaccatggcgcataccgtacgacgttccggactacgcttct [SEQ ID NO: 813]

Amino Acid Sequence
QSVLTQPPSVSGAPGQRVTISCTGSSSNIGAGFDVHWYQLLPGTAPKLLIYANSNRPSGVPD
RFSGSKSGTSASLAITGLLAEDEADYYCQSYDSSLSGVVFGGGTKLTVLGSRGGGGSGGGG
SGGGGSLEMAQVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARGASFDRHDNWGQ
GTLVTVSSTSGQAGQHHHHHHGAYPYDVPDYAS [SEQ ID NO: 814]

TABLE 188

ET200-039
DNA Sequence
aatttttatgctgactcagcccactctgtgtcggagtctccggggaagacggtaaccatctcctgcacccgcagcagtggcagcattgccagca
actatgtgcagtggtaccagcagcgcccgggcagttccccaccactgtgatctatgaggataaccaaagaccctctgggtccctgatcggtt
ctctggctccatcgacagctcctccaactctgcctccctcaccatctctggactgaagactgaggacgaggctgactactactgtcagtcttatgat
agcagcaattgggtgttcggcggagggaccaagctgaccgtcctaggttctagaggtggtggtggtagcggcggcggcggctctggtggtgg
tggatccctcgagatggccgaggtccagctggtgcagtctggggctgaggtgaagaagcctgggtcctcggtgaaggtctcctgcaaggcttc
tggaggcaccttcagcagctatgctatcagctgggtgcgacaggcccctggacaagggcttgagtggatgggagggatcatccctatctttggt
acagcaaactacgcacagaagttccagggcagagtcacgattaccgcggacgaatccacgagcacagcctacatggagctgagcagcctga
gatctgaggacacggccgtgtattactgtgcgcgctctaactactactacaacgattactggggtcaaggtactctggtgaccgtctcctcaacta
gtggccaggccggccagcaccatcaccatcaccatggcgcatacccgtacgacgttccggactacgcttct [SEQ ID NO: 815]

Amino Acid Sequence
NFMLTQPHSVSESPGKTVTISCTRSSGSIASNYVQWYQQRPGSSPTTVIYEDNQRPSGVPDR
FSGSIDSSSNSASLTISGLKTEDEADYYCQSYDSSNWVFGGGTKLTVLGSRGGGGSGGGGS
GGGGSLEMAEVQLVQSGAEVKKPGSSVKVSCKASGGTFSSYAISWVRQAPGQGLEWMGG
IIPIFGTANYAQKFQGRVTITADESTSTAYMELSSLRSEDTAVYYCARSNYYYNDYWGQGT
LVTVSSTSGQAGQHHHHHHGAYPYDVPDYAS [SEQ ID NO: 816]

TABLE 189

ET200-040
DNA Sequence
cagtctgtgttgacgcagccgcctcagtgtctggggccccagggcagagggtcaccatctcctgcactgggagcagctccaacatcggggc
aggttatgatgtacactggtaccagcagcttccaggaacagcccccaaactcctcatctatggtaacagcaatcggccctcaggggtccctgac
cgattctctggctccaagtctggcacttcagcctccctggccatcactgggctccaggctgaggatgaggctgattattactgccagtcctatgac
agcagcctgagtggttatgtcttcggaactgggaccaaggtcaccgtcctaggttctagaggtggtggtggtagcggcggcggcggctctgat
ggtggtggatccctcgagatggcccaggtgcagctggtgcagtctggggctgaggtgaagaagcctggggcctcagtgaaggtctcctgcaa
ggtttccggatacacccttactgaattatccatgcactgggtgcgacaggctcctggaaagggcttgagtggatgggaggttttgatcctgaag
atggtgaaacaatctacgcacagaagttccagggcagagtcaccatgaccgaggacacatctacagacacagcctacatggagctgagcagc
ctgagatctgaggacactgccgtgtattactgtgcgcgctactctggtgtttactacgattggggtcaaggtactctggtgaccgtctcctcaacta
gtggccaggccggccagcaccatcaccatcaccatggcgcatacccgtacgacgttccggactacgcttct [SEQ ID NO: 817]

Amino Acid Sequence
QSVLTQPPSVSGAPGQRVTISCTGSSSNIGAGYDVHWYQQLPGTAPKLLIYGNSNRPSGVP
DRFSGSKSGTSASLAITGLQAEDEADYYCQSYDSSLSGYVFGTGTKVTVLGSRGGGGSGG
GGSGGGGSLEMAQVQLVQSGAEVKKPGASVKVSCKVSGYTLTELSMHWVRQAPGKGLE
WMGGFDPEDGETIYAQKFQGRVTMTEDTSTDTAYMELSSLRSEDTAVYYCARYSGVYYD
WGQGTLVTVSSTSGQAGQHHHHHHGAYPYDVPDYAS [SEQ ID NO: 818]

TABLE 190

ET200-041
DNA Sequence
aatttttatgctgactcagcccactctgtgtcggggtctccggggaagacggtaaccatctcctgcaccggcagcagtggcagcattgccgaca actttgtgcagtggtaccagcagcgcccgggcggtgtccccaccactgtgatctttaatgatgacgaaagaccctctggcgtccctgatcggttc tctggctccatcgacacctcctccaattctgcctccctcaccatctctggactgaagactgaggacgaggctgactactactgtcagtcttatgata ataataatcgaggggtgttcggcggagggaccaagctgaccgtcctaggttctagaggtggtggtggtagcggcggcggcggctctggtggt ggtgatccctcgagatggcccaggtccagctggtgcagtctggggctgaggtgaagaagcctgggtcctcggtgaaggtctcctgcaaggc ttctggaggcaccttcagcagctatgctatcagctgggtgcgacaggcccctggacaagggcttgagtggatgggatggatgaaccctaacag tggtaacacaggctatgcacagaagttccagggcagagtcaccatgaccaggaacacctccataagcacagcctacatggagctgagcaacc tgagatctgaggacacggccgtgtattactgtgcgcgctactacttacggttacgattggggtcaaggtactctggtgaccgtctcctcaacta gtggccaggccggccagcaccatcaccatcaccatggcgcatacccgtacgacgttccggactacgcttct [SEQ ID NO: 819]

Amino Acid Sequence
NFMLTQPHSVSGSPGKTVTISCTGSSGSIADNFVQWYQQRPGGVPTTVIFNDDERPSGVPD
RFSGSIDTSSNSASLTISGLKTEDEADYYCQSYDNNRGVFGGGTKLTVLGSRGGGGSGGG
GSGGGGSLEMAQVQLVQSGAEVKKPGSSVKVSCKASGGTFSSYAISWVRQAPGQGLEWM
GWMNPNSGNTGYAQKFQGRVTMTRNTSISTAYMELSNLRSEDTAVYYCARYYSYGYDW
GQGTLVTVSSTSGQAGQHHHHHHGAYPYDVPDYAS [SEQ ID NO: 820]

TABLE 191

ET200-042
DNA Sequence
cagtctgtcgtgacgcagccgccctcagtgtctggggccccagggcagacggtcaccatctcctgcactgggggcagctccaacatcgggac
aggttattttgtaaattggtaccagcaggttccaggaaaagccccaaactcctcatcctgggtaacaataatcggccctcggggtccctgacc
gactctccggctccacgtccggcacctcagcctccctggccatcactgggctccaggctgaggatgaggtacttattactgccagtcctatgac
agcagcctgagtggttatgtcttcggaactgggaccaaggtcaccgtcctaggttctagaggtggtggtggtagcggcggcggcggctctggt
ggtggtggatccctcgagatggcccaggtacagctgcagcagtcaggtccaggactggtgaagccctcgcagaccctctcactcacctgtgg
catctccgggacagtgtctctaccaacagtgttgcttggcactggatcaggcagtcccatcgagaggccttgagtggctgggaaggacatac
tacaggtccaagtggtctaatgactatggagtatctgtgaaaagtcgaatcaccatcatcccagacacatccaagaaccagttctccctgcagctg
aactctgtgactcccgaggacacggctgtgtattactgtgcgcgctcttcttcttggtaccagatcttcgattactggggtcaaggtactctggtgac
cgtctcctcaactagtggccaggccggccagcaccatcaccatcaccatggcgcatacccgtacgacgttccggactacgcttct [SEQ ID
NO: 821]

Amino Acid Sequence
QSVVTQPPSVSGAPGQTVTISCTGGSSNIGTGYFVNWYQQVPGKAPKLLILGNNNRPSGVP
DRLSGSTSGTSASLAITGLQAEDEGTYYCQSYDSSLSGYVFGTGTKVTVLGSRGGGGSGGG
GSGGGGSLEMAQVQLQQSGPGLVKPSQTLSLTCGISGDSVSTNSVAWHWIRQSPSRGLEW
LGRTYYRSKWSNDYGVSVKSRITIIPDTSKNQFSLQLNSVTPEDTAVYYCARSSSWYQIFD
YWGQGTLVTVSSTSGQAGQHHHHHHGAYPYDVPDYAS [SEQ ID NO: 822]

TABLE 192

ET200-043
DNA Sequence
aattttatgctgactcagccccactctgtgtcggagtctccggggaagacggtaaccatctcctgcaccggcagcagcgacagcatagccaaca
actatgttcagtggtaccagcagcgccccgggcagtgcccccaccaatgtgatctacgaagatgtccaaagaccctctggggtccctgatcggtt
ctctgggtccatcgacagctcctccaactctgcctccctcaccatctctggactgaggactgaggaggctgtctactattgtcagtcttatcat
agcgacaatcgttgggtgttcggcggagggaccaagctgaccgtcctaggttctagaggtggtggtggtagcggcggcggcggctctggtgg
tggtggatccctcgagatggcccaggtgcagctggtggagtctggggggaggcttggtacagcctggggggtcccctgagactctcctgtgcag
cctctggattcacctttagcagctatgccatgagctgggtccgccaggctccagggaaggggctggagtgggtctcagctattagtggtagtggt
ggtagcacatactacgcagactccgtgaagggccggttcaccatctccagagacaattccaagaacacgctgtatctgcaaatgaacagcctg
agagccgaggacacggccgtatattactgtgcgcgctctggtgcttactgggactactgtttacgatgaatggggtcaaggtactctggtgac
cgtctcctcaactagtggccaggccggccagcaccatcaccatcaccatggcgcatacccgtacgacgttccggactacgcttct [SEQ ID
NO: 823]

Amino Acid Sequence
NFMLTQPHSVSESPGKTVTISCTGSSDSIANNYVQWYQQRPGSAPTNVIYEDVQRPSGVPD
RFSGSIDSSSNSASLTISGLKTEDEAVYYCQSYHSDNRWVFGGGTKLTVLGSRGGGGSGGG
GSGGGGSLEMAQVQLVESGGGLVQPGGSLRLSCAASGFTFSSYAMSWVRQAPGKGLEWV
SAISGSGGSTYYADSVKGRFTISRDNSKNTLYLQMNSLRAEDTAVYYCARSGAYWDYSVY
DEWGQGTLVTVSSTSGQAGQHHHHHHGAYPYDVPDYAS [SEQ ID NO: 824]

TABLE 193

ET200-044
DNA Sequence
cagtctgtgttgactcagccaccctcagtgtccgtgtcccaggacagacagccaccatcgcctgttctggacataaattgggggataaatatgc
ttcctggtatcagcagaagtcgggccagtcccctgtgttgatcatctatcaggataataagcggccctcagggattcctgagcgattctctggctc
caactctgggaacacagccactctgaccatcagcgggacccaggctctggatgaggctgactattattgtcaggcgtgggacagtagtacttat
gtggcattcggcggagggaccaagctgaccgtcctaggttctagaggtggtggtggtagcggcggcggcggctctggtggtggtggatccct
cgagatggcccaggtgcagctgcaggagtccggcccaggactggtgaagccttcggagaccctgtccctcacctgcgttgtctctggtggctc
catcagcagtagtaactggtggagctgggtccgccagcccccagggaaggggctggagtggattgggaaatctatcatagtgggagcccc
aactacaacccatccctcaagagtcgagtcaccatatcagtagacaagtccaagaaccagttctccctgaagctgagctctgtgaccgccgcgg
acacggccgtgtattactgtgcgcgcatgactactcatactttcggttacgatgcttggggtcaaggtactctggtgaccgtctcctcaactagtgg
ccaggccggccagcaccatcaccatcaccatggcgcatacccgtacgacgttccggactacgcttct [SEQ ID NO: 825]

Amino Acid Sequence
QSVLTQPPSVSPGQTATIACSGHKLGDKYASWYQQKSGQSPVLIIYQDNKRPSGIPERFS
GSNSGNTATLTISGTQALDEADYYCQAWDSSTYVAFGGGTKLTVLGSRGGGGSGGGGSG
GGGSLEMAQVQLQESGPGLVKPSETLSLTCVVSGGSISSSNWWSWVRQPPGKGLEWIGEI
YHSGSPNYNPSLKSRVTISVDKSKNQFSLKLSSVTAADTAVYYCARMTTHTFGYDAWQG
TLVTVSSTSGQAGQHHHHHHGAYPYDVPDYAS [SEQ ID NO: 826]

TABLE 194

ET200-045
DNA Sequence
cagcctgtgctgactcagccaccctcagtgtcagtggccccaggaaagacggccacgattacttgtgggggaaacaacattggaagtgaaagt
gtgcactggtaccaccagaagccaggccaggccctcgtgttggtcatctatgatgatgccggccggccctcaggatccctgagcgattcact
ggctccaactctgggaacacggccaccctgaccatcagcagggtcgaagccggggatgaggcgactattactgtcaggtgtgggacagaa
atagtgctcagtttgtcttcggacctgggaccaaggtcaccgtcctaggttctagaggtggtggtggtagcggcggcggcggctctggtggtgg
tggatccctcgagatggccgaggtccagctggtgcagtctggagctgaggtgaagaagcctggggcctcagtgaaggtctcctgcaaggcttc
tggttacaccttaccagctatggtatcagctgggtgcgacaggcccctggacaaggcttgagtggatgggatggatcagcgcttacaatggt
aacacaaactatgcacagaagctccagggcagagtcaccacgaccgacacgagcacagcctacatggagctgaggagcctga
gatctgacgacacggccgtgtattactgtgcgcgcggtgttcatctggattggtgggtcaaggtactctggtgaccgtctcctcaactagtggcc
aggccggccagcaccatcaccatcaccatggcgcatacccgtacgacgttccggactacgcttct [SEQ ID NO: 827]

Amino Acid Sequence
QPVLTQPPSVSVAPGKTATITCGGNNIGSESVHWYHQKPGQAPVLVIYDDAGRPSGIPERFT
GSNSGNTATLTISRVEAGDEADYYCQVWDRNSAQFVFGPGTKVTVLGSRGGGGSGGGGS
GGGGSLEMAEVQLVQSGAEVKKPGASVKVSCKASGYTFTSYGISWVRQAPGQGLEWMG
WISAYNGNTNYAQKLQGRVTMTTDTSTSTAYMELRSLRSDDTAVYYCARGVHLDWWGQ
GTLVTVSSTSGQAGQHHHHHHGAYPYDVPDYAS [SEQ ID NO: 828]

TABLE 195

ET200-069
DNA Sequence
cagtctgtcgtgacgcagccaccctcagcgtctgggaccccgggcagagggtcaccatctcttgttctggaagcagctccaacatcggaagt
aattatgtatactggtaccagcagctcccaggaacggccccccaaactcctcatctatagtaataatcagcggccctcaggggtccctgaccgatt
ctctggctccaagtctggcacctcagcctccctggccatcagtgggctccggtcgaggatgaggctgattattactgtgcagcatgggatgac
agcctgagtggttatgtcttcggaactgggaccaaggtcaccgtcctaggttctagaggtggtggtggtagcggcggcggcggctctggtggt
ggtggatccctcgagatggcccaggtgcagctacagcagtggggcgcaggactgttgaagcttcggagaccctgtcctcacctgcgctgtc
tatggtgggtccttcagtggttactactggagctggatccgccagcccccagggaagggctggagtggattggggaaatcaatcatagtgga
agcaccaactacaacccgtccctcaagatcgagtcaccatatcagtagacacagttctccctgaagctgagctctgtgaccg
ccgcggacacggccgtgtattactgtgcgcgcctgtacgaaggtggttaccatggttgggttcttggctgtcttctgattcttggggtcaaggta
ctctggtgaccgtctcctcaactagtggccaggccggccagcaccatcaccatcaccatggcgcatacccgtacgacgttccggactacgcttc
t [SEQ ID NO: 829]

Amino Acid Sequence
QSVVTQPPSASGTPGQRVTISCSGSSSNIGSNYVYWYQQLPGTAPKLLIYSNNQRPSGVPDR
FSGSKSGTSASLAISGLRSEDEADYYCAAWDDSLSGYVFGTGTKLTVLGSRGGGGSGGGG
SGGGGSLEMAQVQLQQWGAGLLKPSETLSLTCAVYGGSFSGYYWSWIRQPPGKGLEWIG
EINHSGSTNYNPSLKSRVTISVDTSKNQFSLKLSSVTAADTAVYYCARLYEGGYHGWGSW
LSSDSWGQGTLVTVSSTSGQAGQHHHHHHGAYPYDVPDYAS [SEQ ID NO: 830]

TABLE 196

ET200-078
DNA Sequence
cagtctgtgttgactcagccaccctcagcgtctgggaccccgggcagagggtcaccatctcttgttctggaagcagctccaacatcggaagta
atactgtaaactggtaccagcagctcccaggaacggccccccaaactcctcatctatagtaataatcagcggccctcaggggtccctgaccgatt
ctctggctccaagtctggcacctcagcctccctggccatcagtgggctccagtctgaggatgaggctgattattactgtgcagcatgggatgaca
gcctgaatggttattgggtgttcggcggagggaccaagctgaccgtcctaggttctagaggtggtggtggtagcggcggcggcggctctggtg
gtggtggatccctcgagatggcccaggtgcagctacagcagtggggcgcaggactgttgaagcttcggagaccctgtcctcacctgcgct
gtctatggtgggtccttcagtggttactactggagctggatccgccagcccccagggaagggctggagtggattggggaaatcaatcatagtg
gaagcaccaactacaacccgtccctcaagagtcgagtcaccatatcagtagacacgtccaagaaccagttctccctgaagctgagctctgtgac
cgccgcggacacggctgtgtattactgtgcgcgcgaaggggcatttgatgcttttgatctggggccaagggacaatggtcaccgtctcttcaa
ctagtggccaggccggccagcaccatcaccatcaccatggcgcatacccgtacgacgttccggactacgcttct [SEQ ID NO: 831]

Amino Acid Sequence
QSVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYWVFGGGTKLTVLGSRGGGGSGG
GGSGGGGSLEMAQVQLQQWGAGLLKPSETLSLTCAVYGGSFSGYYWSWIRQPPGKGLEW
IGEINHSGSTNYNPSLKSRVTISVDTSKNQFSLKLSSVTAADTAVYYCAREGAFDAFDIWGQ
GTMVTVSSTSGQAGQHHHHHHGAYPYDVPDYAS [SEQ ID NO: 832]

TABLE 197

ET200-079
DNA Sequence
tcctatgagctgactcagccaccctcagcgtctgggaccccgggcagagggtcaccatctcttgttctggaagcagctccaacatcggaagta
attatgtatactggtaccagcagctcccaggaacggcccccaaactcttcatctataggaataatcagcggccctcaggggtccctgaccgattc
tctggctccaagtctggcacctcagcctccctggccatcagtgggctccggtccgaggatgaggctgattattactgtgcagcatgggatgaca
gcctgagtggttatctcttcggaactgggaccaaggtcaccgtcctaggttctagaggtggtggtggtagcggcggcggcggctctggtggtg
gtggatccctcgagatggccgaggtgcagctggtggagtctggggggaggcttggtacagcctggcaggtccctgagactctcctgtgcagcct
ctggattcacctttgatgattatgccatgcactgggtccggcaagctccagggaagggcctggagtgggtctcaggtattagttggaatagtggt
agcataggctatgcggactctgtgaagggccgattcaccatctccagagacaacgccaagaacccctgtatctgcaaatgaacagtctgagag
ctgaggacacggccttgtattactgtgcaaatgcgactccaactactactacgtatggacgtctggggcaagggaccacggtcaccgtctc
ctcaactagtggccaggccggccagcaccatcaccatcaccatggcgcatacccgtacgacgttccggactacgcttct [SEQ ID NO: 833]

Amino Acid Sequence
SYELTQPPSASGTPGQRVTISCSGSSSNIGSNYVYWYQQLPGTAPKLFIYRNNQRPSGVPDR
FSGSKSGTSASLAISGLRSEDEADYYCAAWDDSLSGYLFGTGTKVTVLGSRGGGGSGGGG
SGGGGSLEMAEVQLVESGGGLVQPGRSLRLSCAASGFTFDDYAMHWVRQAPGKGLEWV
SGISWNSGSIGYADSVKGRFTISRDNAKNSLYLQMNSLRAEDTALYYCANGDSNYYYGM
DVWGQGTTVTVSSTSGQAGQHHHHHHGAYPYDVPDYAS [SEQ ID NO: 834]

TABLE 198

ET200-081
DNA Sequence
cagtctgccctgactcagcctgcctccgtgtccgggtctcctggacagtcgatcaccatctcctgcactggaaccagcagtgacattggtggttat
aactatgtctcctggtaccaacaacacccaggcaaagcccccaaactcatgatttatgatgtcagtaatcggccctcaggggtttctaatcgcttct
ctggctccaagtctggcaacacggcctccctgaccatctctgggctccaggctgaggacgaggctgattattactgcatctcatatacacgacc
tggaaccccatgtcttcgggagtgggaccaaggtcaccgtcctaggttctagaggtggtggtggtagcggcggcggcggctctggtggtggt
ggatccctcgagatggccgaggtgcagctggtgcagtctgggggaggcgtggtacagcctggggggtccctgagactctcctgtgcagcctc
tggattcacctttgatgattatgccatgcactgggtccgtcaagctccagggaagggtctggagtgggtctctcttattagtggggatggtggtag
cacatactatgcagactctgtgaagggccgattcaccatctccagagacaacagcaaaaactccctgtatctgcaaatgaacagtctgagaactg
aggacacgccttgtattactgtgcaaaagatcgggcagcagctggctactactactacggtatggacgtctggggccaagggaccacggtca
ccgtctcctcaactagtggccaggccggccagcaccatcaccatcaccatggcgcatacccgtacgacgttccggactacgcttct [SEQ ID NO: 835]

Amino Acid Sequence
QSALTQPASVSGSPGQSITISCTGTSSDIGGYNYVSWYQQHPGKAPKLMIYDVSNRPSGVSN
RFSGSKSGNTASLTISGLQAEDEADYYCISYTRTWNPYVFGSGTKVTVLGSRGGGGSGGG
GSGGGGSLEMAEVQLVQSGGGVVQPGGSLRLSCAASGFTFDDYAMHWVRQAPGKGLEW
VSLISGDGGSTYYADSVKGRFTISRDNSKNSLYLQMNSLRTEDTALYYCAKDRAAAGYYY
YGMDVWGQGTTVTVSSTSGQAGQHHHHHHGAYPYDVPDYAS [SEQ ID NO: 836]

TABLE 199

ET200-097
DNA Sequence
ctgcctgtgctgactcagccaccctcagtgtccgtgtccccaggacagacagccatcatcacctgctctggagataaattgggggaaaaatatgt
ttcctggtatcagcagaagccaggccagtcccctgtactggtcatcgatcaagataccaggaggccctcagggatccctgagcgattctctggc
tccaactctgggaccacagccactctgaccatcagcgggacccaggctatgatgaggctgactattactgtcaggcgtgggacaggggtgtg
gtattcggcggagggaccaagctgaccgtcctaggttctagaggtggtggtggtagcggcggcggcggctctggtggtggtggatccctcga
gatggccgaggtgcagctggtggagtctgggggagacttggtacagcctggcaggtccctgagactctcctgtgcagcctctggattcacctttt
aatgattatgccatgcactgggtccggcaagctccagggaagggcctggagtgggtctcaggtattagttggagtggtaataacataggctatg
cggactctgtgaagggccgattcaccatctccagagacaacgccaagaacccctgtatctgcaaatgaacagtctgagagctgaggacacgg
ccttgtattactgtgcaaaagatagtatacggtatggcatcacctggggaggttttgactactggggccagggaaccctggtcaccgtctcctcaa
ctagtggccaggccggccagcaccatcaccatcaccatggcgcatacccgtacgacgttccggactacgcttct [SEQ ID NO: 837]

Amino Acid Sequence
LPVLTQPPSVSVSPGQTAIITCSGDKLGEKYVSWYQQKPGQSPVLVIDQDTRRPSGIPERFSG
SNSGTTATLTISGTQAMDEADYYCQAWDRGVVFGGGTKLTVLGSRGGGGSGGGGSGGG
GSLEMAEVQLVESGGDLVQPGRSLRLSCAASGFTFNDYAMHWVRQAPGKGLEWVSGISW
SGNNIGYADSVKGRFTISRDNAKNSLYLQMNSLRAEDTALYYCKDSIRYGITWGGFDYW
GQGTLVTVSSTSGQAGQHHHHHHGAYPYDVPDYAS [SEQ ID NO: 838]

TABLE 200

ET200-098
DNA Sequence
cagcctgtgctgactcagccaccctcggtgtccaagggcttgagacagaccgccacactcacctgcactgggaacagcaacaatgttggcaa
cctaggagtagcttggctgcagcagcaccagggccaccctcccaaactcctatcctacaggaataacaaccggccctcagggatctcagaga
gattatctgcatccaggtcaggaaacacagcctccctgaccattactggactccagcctgaggacgaggctgactattactgctcagtcatggga
cagtagcctcagtgcttgggtgttcggcggagggaccaagctgaccgtcctaggttctagaggtggtggtggtagcggcggcggcggctctg
gtggtggtggatccctcgagatggccgaggtgcagctggtggagtctgggggagtcgtggtacagcctgggggtcccctgagactctcctgt
gcagcctctggattcacctttgatgattatgccatgcactgggtccgtcaagctccggggaagggtctggagtgggtctctcttattaattgggatg
gtggtagcacctactatgcagactctgtgaagggtcgattcaccatctccagagacaacagcaaaaactccctgtatctgcaaatgaacagtctg
agagctgaggacaccgccttgtattactgtgcaaaagggatgggcctgagggcgtttgactactggggccagggaaccctggtcaccgtctcc
tcaactagtggccaggccggccagcaccatcaccatcaccatggcgcataccgtacgacgttccggactacgcttct [SEQ ID NO: 839]

Amino Acid Sequence
QPVLTQPPSVSKGLRQTATLTCTGNSNNVGNLGVAWLQQHQGHPPKLLSYRNNNRPSGIS
ERLSASRSGNTASLTITGLQPEDEADYYCSAWDSSLSAWVFGGGTKLTVLGSRGGGGSGG
GGSGGGGSLEMAEVQLVESGGVVVQPGGSLRLSCAASGFTFDDYAMHWVRQAPGKGLE
WVSLINWDGGSTYYADSVKGRFTISRDNSKNSLYLQMNSLRAEDTALYYCAKGMGLRAF
DYWGQGTLVTVSSTSGQAGQHHHHHHGAYPYDVPDYAS [SEQ ID NO: 840]

TABLE 201

ET200-099
DNA Sequence
cagtctgtgttgactcagccaccctcagcgtctgggaccccgggcagagggtcaccatctcctgttctggaagcagctccaacatcggaagta
atactgtaaactggtaccagcagctcccaggaacggcccccaaactcctcatctatagtaatgatcagcggccctcaggggtccctgaccgatt
ctctggctccaagtccggcaccctcagcctccctggccatcagtgggctccagtctgaggctgaggctgattattactgtgcttcatgggatgaca
gcctgaatggccgttatgtcttcggaactgggaccaaggtcaccgtcctaggttctagaggtggtggtggtagcggcggcggcggctctggtg
gtggtggatccctcgagatggcccaggtccagctggtacagtctggggctgaggtgaggaagcctggggcctcagtgaaggtttcctgcaag
acttctggatacaccttcagttggtatgctatacattgggtgcgccaggcccccggacaaaggcttgagtggatgggatggatcaacgctggca
atggaaacacaaaatattcacagaaatttcagggcagagtcagtcttaccagggacacatccgcgagcacagcctacatggagctgagcagcc
tgagatctgatgacacggctgtgtattactgtgcgagaccgataatatggttcgggtgggatgttttgatatctggggccaagggacaatgg
tcaccgtctcttcaactagtggccaggccggccagcaccatcaccatcaccatggcgcataccgtacgacgttccggactacgcttct [SEQ ID NO: 841]

Amino Acid Sequence
QSVLTQPPSASGTPGQRVTISCSGSSSNIGSNTVNWYQQLPGTAPKLLIYSNDQRPSGVPDR
FSGSKSGTSASLAISGLQSEDEADYYCASWDDSLNGRYVFGTGTKVTVLGSRGGGGSGGG
GSGGGGSLEMAQVQLVQSGAEVRKPGASVKVSCKTSGYTFSWYAIHWVRQAPGQRLEW
MGWINAGNGNTKYSQKFQGRVSLTRDTSASTAYMELSSLRSDDTAVYYCARPDNYGSGG
DVFDIWGQGTMVTVSSTSGQAGQHHHHHHGAYPYDVPDYAS [SEQ ID NO: 842]

TABLE 202

ET200-100
DNA Sequence
aattttatgctgactcagccccactctgtgtcggagtctccggggaagacggtaaccatctcctgcacccgcagcagtggcagcattgccagca
actttgtgcagtggtaccagcagcgcccgggcagtgcccccaccctatgatctatgaggataacaacagaccccctggggtccctgatcggtt
ctctgcctccgtcgacagctcctccaactctgcctccctcaccatctctggactgaagactgaggacgaggctgactactactgtcagtcttatgat
accagcaatgtggtattcggcgggggaccaagctgaccgtcctaggttctagaggtggtggtggtagcggcggcggcggctctggtggtgg
tggatccctcgagatggccgaggtgcagctggtggagtctgggggaggcttggtacagcctggagggtcccctgagactcctgtgcagcctc
tggattcaccttcagtagttatgaaatgaactgggtccgccaggctccagggaaggggctggagtgggtttcatacattagtagtagtggtagtac
catatactacgcagactctgtgaagggccgattcaccatctccagagacaacgccaagaactcactgtatctgcaaatgaacagcctgagagcc
gaggacacggctgtttattactgtgcacgctgggactacggtatggacgtctggggccaagggaccacggtcaccgtctcctcaactagtggc
caggccggccagcaccatcaccatcaccatggcgcataccgtacgacgttccggactacgcttct [SEQ ID NO: 843]

Amino Acid Sequence
NFMLTQPHSVSESPGKTVTISCTRSSGSIASNFVQWYQQRPGSAPTPMIYEDNNRPPGVPDR
FSASVDSSSNSASLTISGLKTEDEADYYCQSYDTSNVVFGGGTKLTVLGSRGGGGSGGGGS
GGGGSLEMAEVQLVESGGGLVQPGGSLRLSCAASGFTFSSYEMNWVRQAPGKGLEWVSY
ISSSGSTIYYADSVKGRFTISRDNAKNSLYLQMNSLRAEDTAVYYCARWDYGMDVWGQG
TTVTVSSTSGQAGQHHHHHHGAYPYDVPDYAS [SEQ ID NO: 844]

TABLE 203

ET200-101
DNA Sequence
caggctgtgctgactcagccaccctcagcgtctggggcccccgggcagagggtcaccgtctcttgttctggaagcaactccaacatcggaagt
aactacgttaactggtaccagcagttcccaggaacggcccccaaactcctcatgtatagtagtagtcagcggccctcaggggtccctgaccgat
tctctggctccaagtctggcacctcagcctccctggccatcagtgggctccactctgaggatgaggctgattattactgtgctacatgggatgaca
gcctgaatgcttgggtgttcggcggagggaccaagctgaccgtcctaggttctagaggtggtggtggtagcggcggcggcggctctggtggt
ggtggatccctcgagatggccgaggtccagctggtgcagtctggggctgaggtgaggaagcctggggcctcagtgaaggtttcctgcaagac
ttctggatacaccttcacttggtatgctatacattgggtgcgccaggcccccggacaaaggcttgagtggatgggatggatcaacgctggcagtg
gaaacacaaaatattcacagaaatttcagggcagagtcaccctcaccgagcacatccgcgagcacagcgtacatggagctgagcagcctg
agatctgatgacacggctgtgtattactgtgcgagacccaataactatggttcgggtggggatgtttttgatatctggggccaagggacaatggtc
accgtctcttcaactagtggccaggccggccagcaccatcaccatcaccatggcgcatacccgtacgacgttccggactacgcttct [SEQ
ID NO: 845]

Amino Acid Sequence
QAVLTQPPSASGAPGQRVTVSCSGSNSNIGSNYVNWYQQFPGTAPKLLMYSSSQRPSGVP
DRFSGSKSGTSASLAISGLHSEDEADYYCATWDDSLNAWVFGGGTKLTVLGSRGGGGSGG
GGSGGGGSLEMAEVQLVQSGAEVRKPGASVKVSCKTSGYTFTWYAIHWVRQAPGQRLE
WMGWINAGSGNTKYSQKFQGRVTLTRDTSASTAYMELSSLRSDDTAVYYCARPNNYGSG
GDVFDIWGQGTMVTVSSTSGQAGQHHHHHHGAYPYDVPDYAS [SEQ ID NO: 846]

TABLE 204

ET200-102
DNA Sequence
cagtctgtcgtgacgcagccgccctcagtgtctgcggccccaggacagaaggtcaccatctcctgctctggaagcagctccaacattgggaat
aattatgtatcctggtaccagcagctcccaggaacagcccccaaactcctcatttatgacaataataagcgaccctcagggattcctgaccgattc
tctggctccaagtctggcacgtcagccaccctgggcatcaccggactccagactggggacgaggccgattattactgcggaacatgggatagc
agcctgagtgcttatgtcttcggaactgggaccaagctcaccgtcctaggttctagaggtggtggtggtagcggcggcggcggctctggtggtg
gtggatccctcgagatggcccaggtccagctggtgcagtctggggctgaggtgaagaagcctggggcctcagtgaaagtttcctgcaaggctt
ctggatacaccttcacgaactatgctctgcattgggtgcgccaggcccccggacaagggcttgagtggatggcatggatcaacggtggcaatg
gtaacacaaaatattcacagaacttccagggcagagtcaccattaccagggacacatccgcgagcacagcctatatggagctgagcagcctga
gatctgaagacacggctgtgtattactgtgcgaaaccggaggaaacagctggaacaatccactttgactactggggcagggaacccgtca
ccgtctcctcaactagtggccaggccggccagcaccatcaccatcaccatggcgcatacccgtacgacgttccggactacgcttct [SEQ
ID NO: 847]

Amino Acid Sequence
QSVVTQPPSVSAAPGQKVTISCSGSSSNIGNNYVSWYQQLPGTAPKLLIYDNNKRPSGIPDR
FSGSKSGTSATLGITGLQTGDEADYYCGTWDSSLSAYVFGTGTKVTVLGSRGGGGSGGGG
SGGGGSLEMAQVQLVQSGAEVKKPGASVKVSCKASGYTFTNYALHWVRQAPGQGLEW
MAWINGGNGNTKYSQNFQGRVTITRDTSASTAYMELSSLRSEDTAVYYCAKPEETAGTIH
FDYWGQGTPVTVSSTSGQAGQHHHHHHGAYPYDVPDYAS [SEQ ID NO: 848]

TABLE 205

ET200-103
DNA Sequence
caggctgtgctgactcagccccactctgtgtcggagtctccggggaagacggtaaccatctcctgcacccgcagcagtggcagcattgccagc
aactatgtgcagtggtaccagcagcgcccgggcagtgcccccaccactgtgatctatgaggataaccaaagaccctctggggtccctgatcgg
ttctctggctccatcgacagctcctccaactctgcctccctcaccatctctggactgaagactgaggacgaggctgactactactgtcagtcttatg
atagcaccatcacggtgttcggcggagggaccaagctgaccgtcctaggttctagaggtggtggtggtagcggcggcggcggctctggtggt
ggtggatccctcgagatggcccaggtccagctggtacagtctggggctgaggtgaagaagcctgggtcctcggtgaaggtctcctgcaaggc
ttctggaggcacctcagcagctatgctatcagctgggtgcgacaggcccctggacaagggcttgagtggatggagggatcatccctatctttt
ggtacagcaaactacgcacagaagttccagggcagagtcacgattaccgcggacgaatccacgagcacagcctacatggagctgagcagcc
tgagatctgaggacacggccgtgtattactgtgcggggagggttactatgatagtagtggttattccaacggtgatgcttttgatatctggggcc
aagggacaatggtcaccgtctcttcaactagtggccaggccggccagcaccatcaccatcaccatggcgcatacccgtacgacgttccggact
acgcttct [SEQ ID NO: 849]

Amino Acid Sequence
QAVLTQPHSVSESPGKTVTISCTRSSGSIASNYVQWYQQRPGSAPTTVIYEDNQRPSGVPDR
FSGSIDSSSNSASLTISGLKTEDEADYYCQSYDSTITVFGGGTKLTVLGSRGGGGSGGGGSG
GGGSLEMAQVQLVQSGAEVKKPGSSVKVSCKASGGTFSSYAISWVRQAPGQGLEWMGGI
IPIFGTANYAQKFQGRVTIADESTSTAYMELSSLRSEDTAVYYCAGEGYYDSSGYSNGDA
FDIWGQGTMVTVSSTSGQAGQHHHHHHGAYPYDVPDYAS [SEQ ID NO: 850]

TABLE 206

ET200-104
DNA Sequence
aattttatgctgactcagcccactctgtgtcggagtctccggggaagacggtaaccatctcctgcacccgcagcagtggcagcattgccagca
actatgtgcagtggtaccagcagcgcccgggcagtgccccaccactgtgatctatgaggataaccaaagaccctctggggtccctgatcggtt
ctctggctccatcgacagctcctccaactctgcctccctcaccatctctggactgaagactgaggacgaggctgactactactgtcagtcttatgat
agcagcaatgtggtattcggcggagggaccaaggttcaccgtcctaggttctagaggtggtggtggtagcggcggcggcggctctggtggtgg
tggatccctcgagatggccgaggtgcagctggtggagtctgggggaggcttggtacagcctggagggtccctgagactcctgtgcagcctc
tggattccacttcagtagttatgaaatgaactgggtccgccaggctccagggaagggctggagtgggtttcatacattagtagtagtggtagtac
catatactacgcagactctgtgaagggccgattcaccatctccagagacaacgccaagaactcactgtatctgcaaatgaacagcctgagagcc
gaggacacggctgtttattactgtgcacgctgggactacggtatggacgtctggggccaagggaccacggtcaccgtctcctcaactagtggc
caggccggccagcaccatcaccatcaccatggcgcatacccgtacgacgttccggactacgcttct [SEQ ID NO: 851]

Amino Acid Sequence
NFMLTQPHSVSESPGKTVTISCTRSSGSIASNYVQWYQQRPGSAPTTVIYEDNQRPSGVPDR
FSGSIDSSSNSASLTISGLKTEDEADYYCQSYDSSNVVFGGGTKVTVLGSRGGGSGGGGS
GGGGSLEMAEVQLVESGGGLVQPGGSLRLSCAASGFTFSSYEMNWVRQAPGKGLEWVSY
ISSSGSTIYYADSVKGRFTISRDNAKNSLYLQMNSLRAEDTAVYYCARWDYGMDVWGQG
TTVTVSSTSGQAGQHHHHHHGAYPYDVPDYAS [SEQ ID NO: 852]

TABLE 207

ET200-105
DNA Sequence
tcctatgtgctgactcagccaccctcagtgtccgtgtccccaggacagacagccagcatcacctgctctggagatagattgacgaataaatatgtt
tcctggtatcaacagaagccaggccagtcccctgtgttggtcatctatgaggatgccaagcggccctcagggatccctgcgcgattctctggctc
caactctgggaacacagctcctgaccatcagcgggacccaggctatgatgagtcctatattactgtcaggcgtgggacagcagtgtggt
ggttttggcggagggaccaagctgaccgtcctaggttctagaggtggtggtggtagcggcggcggcggctctggtggtggtggatccctcga
gatggccgaggtgcagctggtggagtctgggggaggcttggtacagcctggcaggtccctgagactcctgtgcagcctctggatttaccttt
gatgattatgccatgcactgggtccggcaagctccagggaagggcctggagtgggtctcaggtattagttggaatagtggtagtataggctatg
cggactctgtgaagggccgattcaccatctccagagacaacgccaagaactccctgtatctgcaaatgaacagtctgagagatgaggacacgg
ccttgtattactgtgcaaaagaccgaggggggggagttatcgttaaggatgcttttgatatctggggccaagggacaatggtcaccgtctcttcaa
ctagtggccaggccggccagcaccatcaccatcaccatggcgcatacccgtacgacgttccggactacgcttct [SEQ ID NO: 853]

Amino Acid Sequence
SYVLTQPPSVSVSPGQTASITCSGDRLTNKYVSWYQQKPGQSPVLVIYEDAKRPSGIPARFS
GSNSGNTATLTISGTQAMDESEYYCQAWDSSVVVFGGGTKLTVLGSRGGGSGGGGSGG
GGSLEMAEVQLVESGGGLVQPGRSLRLSCAASGFTFDDYAMHWVRQAPGKGLEWVSGIS
WNSGSIGYADSVKGRFTISRDNAKNSLYLQMNSLRDEDTALYYCAKDRGGVIVKDAFDI
WGQGTMVTVSSTSGQAGQHHHHHHGAYPYDVPDYAS [SEQ ID NO: 854]

TABLE 208

ET200-106
DNA Sequence
tcctatgagctgactcagccacccgcagcgtctgggacccccggacagagagtcaccatctcttgttctgggggcgtctccaacatcgggagt
ggtgctctaaattggtaccagcaactcccaggaacggcccccaaactcctcatctatagttacaatcagcggccctcaggggtctctgaccgatt
ctctggctccaggtctgccacctcagcctccctggccatcagtgggctccagtctgaggatgaggctgattattactgtgcaacctgggatgata
gtgtgaatggttgggtgttcggcggagggaccaagctgaccgtcctaggttctagaggtggtggtggtagcggcggcggcggctctggtggt
ggtggatccctcgagatggccgaggtgcagctggtggagtctggagctgaggtgaagaagcctggggattcagtgaaggtctcctgcaagcc
ttctggttacaattttctcaactatggtatcaactgggtgcgacaggcccctggacaagggcttgagtggatgggatggattagcacttacaccgg
taacacaaactatgcacagaagctgcagggcagagtcaccttcaccacagacacatccacgagcacagcctacatggagatgaggagcctga
gatctgacgacacggccgtgtattactgtgcgcgccagcagggtggtggttggtacgatgtttggggtcaagtactctggtcaccgtctcctca
actagtggccaggccggccagcaccatcaccatcaccatggcgcatacccgtacgacgttccggactacgcttct [SEQ ID NO: 855]

Amino Acid Sequence
SYELTQPPAASGTPGQRVTISCSGGVSNIGSGALNWYQQLPGTAPKLLIYSYNQRPSGVSDR
FSGSRSATSASLAISGLQSEDEADYYCATWDDSVNGWVFGGGTKLTVLGSRGGGSGGG
GSGGGGSLEMAEVQLVESGAEVKKPGDSVKVSCKPSGYNFLNYGINWVRQAPGQGLEW
MGWISTYTGNTNYAQKLQGRVTFTTDTSTSTAYMEMRSLRSDDTAVYYCARQQGGGWY
DVWGQGTLVTVSSTSGQAGQHHHHHHGAYPYDVPDYAS [SEQ ID NO: 856]

TABLE 209

ET200-107
DNA Sequence
cagtctgtcgtgacgcagccgcccctcagtgtctgcggccccaggagagaaggtcaccatctcctgctctggaagcaacttcaatgttggaaata
atgatgtatcctggtatcagcaactcccaggtgcagccccaaactcctcatttatgacaataataagcgaccctcagggattcctgaccgattctc
tggctccaagtctggcacgtcagccacccctggactcaccggctccacagtgacgacgaggccgattattactgcggaacatgggatagca
gcctgaatactggggggggtcttcggaactgggaccaaggtcaccgtcctaggttctagaggtggtggtggtagcggcggcggcggctctggt
ggtggtggatcccctcgagatggccgaggtccagctggtgcagtctggagctgaggtgaagaagcctggggcctcagtgaaggtctcctgcaa
ggcttctggttacacctttaccagctatactatcagctgggtacgacaggcccctggacaagggcttgagtggatgggatggatcagcacttaca
atggtctcacaaactatgcacagaacctccagggcagagtcaccatgactacagacacattcacgaccacagcctacatggagctgaggagc
ctcagatctgacgacacggccgtgtattactgtgtgagagaggggtccccgactacggtgacttcgcgtcctttgactactggggccagggaa
ccctggtcaccgtctcctcaactagtggccaggccggccagcaccatcaccatcaccatggcgcatacccgtacgacgttccggactacgcttc
t [SEQ ID NO: 857]

Amino Acid Sequence
QSVVTQPPSVSAAPGEKVTISCSGSNFNVGNNDVSWYQQLPGAAPKLLIYDNNKRPSGIPD
RFSGSKSGTSATLDITGLHSDDEADYYCGTWDSSLNTGGVFGTGTKVTVLGSRGGGGSGG
GGSGGGGSLEMAEVQLVQSGAEVKKPGASVKVSCKASGYTFTSYTISWVRQAPGQGLEW
MGWISTYNGLTNYAQNLQGRVTMTTDTFTTTAYMELRSLRSDDTAVYYCVREGSPDYGD
FASFDYWGQGTLVTVSSTSGQAGQHHHHHHGAYPYDVPDYAS [SEQ ID NO: 858]

TABLE 210

ET200-108
DNA Sequence
cagtctgtgttgacgcagccgcccctcagtgtctgcgccccgggacagaaggtcaccatctcctgctctggaagcagctccaacattgggaata
attatgtatcctggtaccagcagttcccaggaacagcccccaaactcctcatttatgacaataataagcgaccctcagggatttctgaccgattctc
tggctccaagtctggcacgtcagccacctgggcatccgggactccagactgggacaggccgattattactgcggaacatgggatacca
gcctgagtggttttatgtcttcggaagtgggaccaaggtcaccgtcctaggttctagaggtggtggtggtagcggcggcggcggctctggtggt
ggtggatcccctcgagatggccgaggtccagctggtacagtctggagctgaggtgaagaagcctggggcctcagtgaaggtctcctgcaaggc
ttctggttacacctttaccagctatactatcagctgggtacgacaggcccctggacaagggcttgagtggatgggatggatcagcacttacaatg
gtctcacaaactatgcacagaacctccagggcagagtcaccatgactacagacacattcacgaccacagcctacatggagctgaggagcctca
gatctgacgacacggccgtgtattactgtgtgagagaggggtccccgactacggtgacttcgcgtcctttgactactggggccagggaaccct
ggtcaccgtctcctcaactagtggccaggccggccagcaccatcaccatcaccatggcgcatacccgtacgacgttccggactacgcttct
[SEQ ID NO: 859]

Amino Acid Sequence
QSVLTQPPSVSAPPGQKVTISCSGSSSNIGNNYVSWYQQFPGTAPKLLIYDNNKRPSGISDRF
SGSKSGTSATLGIAGLQTGDEADYYCGTWDTSLSGFYVFGSGTKVTVLGSRGGGGSGGGG
SGGGGSLEMAEVQLVQSGAEVKKPGASVKVSCKASGYTFTSYTISWVRQAPGQGLEWMG
WISTYNGLTNYAQNLQGRVTMTTDTFTTTAYMELRSLRSDDTAVYYCVREGSPDYGDFA
SFDYWGQGTLVTVSSTSGQAGQHHHHHHGAYPYDVPDYAS [SEQ ID NO: 860]

TABLE 211

ET200-109
DNA Sequence
ctgcctgtgctgactcagccaccctcagcgtctgcgaccccggggcagagggtcaccatctcttgttctggaaccacctccaacatcggaagta
atactgtacactggtaccagcagctcccaggacggccccccaaactcctcatctataataataatcagcggccctcaggggtccctgaccgatt
ctctggctccaagtctggcacctcagcctccctggccatcagtgggctccggtccgaggatgaggctacatattcctgtgcaacatgggatgac
agcctgagtggtgtggtcttcggcggagggaccaagctgaccgtcctaggttctagaggtggtggtggtagcggcggcggcggctctggtgg
tggtggatcccctcgagatggccgaggtccagctggtgcagtctggggctgaggtgaagaagcctgggtcctcggtgaaggtctcctgcaagg
cttctggaggcaccttcagcagctatgctatcagctgggtgcgacaggcccctggacaagggcttgagtggatgggagggatcatccctatcttt
ggtacagcaaactacgcacagaagttccagggcagagtcacgattaccgcggacgaatccacgagcacagcctacatggagctgagcagcc
tgagatctgaggacacggccgtgtattactgtgcgagagatcccgcctacggtgactacgagtatgatgcttttgatatctggggccaagggaca
atggtcaccgtctcttcaactagtggccaggccggccagcaccatcaccatcaccatggcgcatacccgtacgacgttccggactacgcttct
[SEQ ID NO: 861]

Amino Acid Sequence
LPVLTQPPSASATPGQRVTISCSGTTSNIGSNTVHWYQQLPGTAPKLLIYNNNQRPSGVPDR
FSGSKSGTSASLAISGLRSEDEATYSCATWDDSLSGVVFGGGTKLTVLGSRGGGGSGGGGS
GGGGSLEMAEVQLVQSGAEVKKPGSSVKVSCKASGGTFSSYAISWVRQAPGQGLEWMGG
IIPIFGTANYAQKFQGRVTITADESTSTAYMELSSLRSEDTAVYYCARDPAYGDYEYDAFDI
WGQGTMVTVSSTSGQAGQHHHHHHGAYPYDVPDYAS [SEQ ID NO: 862]

TABLE 212

ET200-110
DNA Sequence
cagtctgtgttgacgcagccgccctcagcgtctgggaccccgggcagagggtcaccatctcttgttctggaagcagctccaacatcggaacta
atggtgtaaactggttccagcagttcccaggaacggcccccaaactcctcatctatactaatgatcagcggccctcaggggtccctgaccgattc
tctggctccaagtctggcacctcagcctccctggccatcagtgggctccagtctgcggatgaggctgattattactgtgcagtgtgggaccacag
cctgaatggtccggtgttcggcggagggaccaagctgaccgtcctaggttctagaggtggtggtggtagcggcggcggcggctctggtggtg
gtggatccctcgagatggcccaggtgcagctggtgcagtctggggctgaggtgaagaagcctgggtcctcggtgaaggtctcctgcaaggctt
ctggaggcaccttcagcagctatgctatcagctgggtgcgacaggcccctggacaagggcttgagtggatgggagggatcatccctatctttgg
tacagcaaactacgcacagaagttccaggggcagagtcacgattaccgcggacgaatccacgagcacagcctacatggagctgagcagcctg
agatctgaggacacggccgtgtattactgtgcgagaggggccggttttgatgcttttgatatctgggggcaagggacaatggtcaccgtctcttca
actagtggccaggccggccagcaccatcaccatcaccatggcgcataccgtacgacgttccggactacgcttct [SEQ ID NO: 863]

Amino Acid Sequence
QSVLTQPPSASGTPGQRVTISCSGSSSNIGTNGVNWFQQFPGTAPKLLIYTNDQRPSGVPDR
FSGSKSGTSASLAISGLQSADEADYYCAVWDHSLNGPVFGGGTKLTVLGSRGGGGSGGGG
SGGGGSLEMAQVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARGAGFDAFDIWGQ
GTMVTVSSTSGQAGQHHHHHHGAYPYDVPDYAS [SEQ ID NO: 864]

TABLE 213

ET200-111
DNA Sequence
caggctgtgctgactcagccaccctcagcgtctgggaccccgggcagagggtcaccatctcttgttctggaagcagctccaacatcggaagt
aatactgtaaactggtaccagcagctcccaggaacggcccccaaactcctcatctatagtaataatcagcggccctcaggggtccctgaccgat
tctctggctccaagtctggcacctcagcctccctggccatcagtgggctccagtctgaggatgaggctgattattactgtgcagcatgggatgac
agcctgaatggttatgtcttcggaactgggaccaagctcaccgtcctaggttctagaggtggtggtggtagcggcggcggcggctctggtggtg
gtggatccctcgagatggcccaggtgcagctacagcagtggggcgcaggactgttgaagccttcggagaccctgtcctcacctgcgctgtct
atggtgggtccttcagtggttactactggagctggatccgccagcccccagggaaggggctggagtggattgggaaatcaatcatagtggaa
gcaccaactacaacccgtccctcaagagtcgagtcaccatatcagtagacacgtccaagaaccagttctcctgaagctgagctctgtgaccgc
cgcggacacggctgtgtattactgtgcgagagagggccgtagatgcttttgatatctgggggccaagggacaatggtcaccgtctcttcaactagtg
gccaggccggccagcaccatcaccatcaccatggcgcataccgtacgacgttccggactacgcttct [SEQ ID NO: 865]

Amino Acid Sequence
QAVLTQPPSASGTPGQRVTISCSGSSSNIGSNTVNWYQQLPGTAPKLLIYSNNQRPSGVPDR
FSGSKSGTSASLAISGLQSEDETDYYCAAWDDSLNGYVFGTGTKVTVLGSRGGGGSGGGG
SGGGGSLEMAQVQLQQWGAGLLKPSETLSLTCAVYGGSFSGYYWSWIRQPPGKGLEWIG
EINHSGSTNYNPSLKSRVTISVDTSKNQFSLKLSSVTAADTAVYYCAREGLDAFDIWGQGT
MVTVSSTSGQAGQHHHHHHGAYPYDVPDYAS [SEQ ID NO: 866]

TABLE 214

ET200-112
DNA Sequence
caggctgtgctgactcagccaccctcagcgtctgggaccccgggcagagggtcaccatctcttgttctggaagcagctccaacatcggaagt
aatactgtaaactggtaccagcagctcccaggaacggcccccaaactcctcatgtatagtaatgatcagcggccctcaggggtccctgaccgat
tctctggctccaagtctggcacctcagcctccctggccatcagtgggctccagtctgaggatgaggctgattattattgtgcagcatgggatgaca
gcctgaatggttatgtcttcgcagctgggaccagctcaccgttttaagttctagaggtggtggtggtagcggcggcggcggctctggtggtggt
ggatccctcgagatggcccaggtgcagctacagcagtggggcgcaggactgttgaagccttcggagaccctgtcctcacctgcgctgtctat
ggtgggtccttcagtggttactactggagctggatccgccagcccccagggaaggggctggagtggattgggaaatcaatcatagtggaag
caccaactacaacccgtccctcaagagtcgagtcaccatatcagtagacacgtccaagaaccagttctccctgaagctgagctctgtgaccgcc
gcggacacggctgtgtattactgtgcgagagagggctagatgcttttgatatctgggggccaagggacaatggtcaccgtctcttcaactagtgg
ccaggccggccagcaccatcaccatcaccatggcgcataccgtacgacgttccggactacgcttct [SEQ ID NO: 867]

Amino Acid Sequence
QAVLTQPPSASGTPGQRVTISCSGSSSNIGSNTVNWYQQLPGTAPKLLMYSNDQRPSGVPD
RFSGSKSGTSASLAISGLQSEDEADYYCAAWDDSLNGYVFAAGTQLTVLSSRGGGGSGGG
GSGGGGSLEMAQVQLQQWGAGLLKPSETLSLTCAVYGGSFSGYYWSWIRQPPGKGLEWI
GEINHSGSTNYNPSLKSRVTISVDTSKNQFSLKLSSVTAADTAVYYCAREGLDAFDIWGQG
TMVTVSSTSGQAGQHHHHHHGAYPYDVPDYAS [SEQ ID NO: 868]

TABLE 215

ET200-113
DNA Sequence
cagtctgtcgtgacgcagccgccctcagtgtctgcggccccaggacagaaggtcaccatctcctgctctggaagcagctccaacattgggaat
aattatgtatcctggtaccagcagctcccaggaacagcccccaaactcctcatttatgacaataataagcgaccctcagggattcctgaccgatt
ctctggctccaagtctggcacgtcagccaccctgggcatcactggactccagactggggacgaggccgattattactgcggaacatgggatagc
agcctggagtgctgcttatgtcttcggaactgggaccaaggtcaccgtcctaggttctagaggtggtggtggtagcggcggcggcggctctggtg
gtggtggatccctcgagatggcccaggtccagctggtacagtctggagctgaggtgaagaagcctggggcctcagtgaaggtctcctgcaag
gcttctggttacagctttaccagctatactatcagctgggttcgacaggcccctggacaaggccttgagtggatgggatgggtcagcacttacaa
tggtctcagaaactatgcacagaacctccagggcagagtcacaatgaccacagacactcaagaccacagcctacatggagctgaggagcct
cagatctgacgacacggccgtgtattattgtgtgagagaggggtcccccgactacggtgacttcgcggcctttgactactggggccagggcac
cctggtcaccgtctcctcaactagtggccaggccggccagcaccatcaccatcaccatggcgcatacccgtacgacgttccggactacgcttct
[SEQ ID NO: 869]

Amino Acid Sequence
QSVVTQPPSVSAAPGQKVTISCSGSSSNIGNNYVSWYQQLPGTAPKLLIYDNNKRPSGIPDR
FSGSKSGTSATLGITGLQTGDEADYYCGTWDSSLSAAYVFGTGTKVTVLGSRGGGSGGG
GSGGGGSLEMAQVQLVQSGAEVKKPGASVKVSCKASGYSFTSYTISWVRQAPGQGLEWM
GWVSTYNGLRNYAQNLQGRVTMTTDTLTTTAYMELRSLRSDDTAVYYCVREGSPDYGD
FAAFDYWGQGTLVTVSSTSGQAGQHHHHHHGAYPYDVPDYAS [SEQ ID NO: 870]

TABLE 216

ET200-114
DNA Sequence
caggctgtgctgactcagccaccctcagcgtctgagaccccggggcagagggtcaccatctcttgttctggaagcaggtccaacatcggaact
aatattgtacactggtaccagcagcgccaggaatggccccaaactcctcacttatggtagtcggcggcccctcagggggtcccgaccgattct
ctggctccaagtttggcacctcagcctccctggccatcagtgggctccagtctgaggatgaggctgattattattgtgcagcatgggatgacagt
ctgaatggtccggctttcggcggagggaccaagctgaccgtcctaggttctagaggtggtggtggtagcggcggcggcggctctggtggtggt
ggatccctcgagatggcccaggtgcagctacagcagtggggcgcaggactgttgaagcctcggagaccctgtcctcacctgcgctgtctat
ggtgggtccttcagtggttactactggagctggatccgccagcccccagggaaggggctggagtggattgggaaatcaatcatagtggaag
caccaactacaacccgtccctcaagagtcgagtcaccatatcagtagacacgtccaagaaccagttctccctgaagctgagctctgtgaccgcc
gcggacacggctgtgtattactgtgcgagagacggtgggggctactttgactactggggccagggaaccctggtcaccgtctcctcaactagtg
gccaggccggccagcaccatcaccatcaccatggcgcatacccgtacgacgttccggactacgcttct [SEQ ID NO: 871]

Amino Acid Sequence
QAVLTQPPSASETPGQRVTISCSGSRSNIGTNIVHWYQQRPGMAPKLLTYGSRRPSGVPDRF
SGSKFGTSASLAISGLQSEDEADYYCAAWDDSLNGPAFGGGTKLTVLGSRGGGSGGGS
GGGGSLEMAQVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCARDGGGYFDYWGQGTL
VTVSSTSGQAGQHHHHHHGAYPYDVPDYAS [SEQ ID NO: 872]

TABLE 217

ET200-115
DNA Sequence
cagtctgtgttgacgcagccgccctcagtgtctggggccccagggcagagggtcaccatctcctgcactgggagcagctccaatatcgggc
acgttatgatgtacactggtaccagcaactcccaggaacagcccccgactcctcatctctgctaactacgatcggccctcaggggtccctgac
cgattctctggctccaagtctggcacctcagcctccctggccatcactgggctccaggctgaggatgaggctgattattactgccagtcctatga
cagcagtgtgagtgctgggtgttcggcggagggaccaaggtcaccgtcctaggttctagaggtggtggtggtagcggcggcggcggctctgg
tggtggtggatccctcgagatggccgaagtgcagctggtgcagtctggggctgaagtgaaggagcctggggcctcagtgaggatctcctgcc
aggcatctggatacaacttcatcagttattatatgcactgggtgcgcaggcccctgggcaaggtcttgagtggatgggcaccatcaacccagg
cagtggtgagacagactactcacagaagttgcagggcagagtcaccatgaccagggaccgtccacgggtacattcgacatgggctgagc
agcctgacatctggggacacggccgtctattattgtgcgacaggtctcatcagaggagctagcgatgcttttaatatctggggccgggggacaat
ggtcaccgtctcttcaactagtggccaggccggccagcaccatcaccatcaccatggcgcatacccgtacgacgttccggactacgcttct
[SEQ ID NO: 873]

Amino Acid Sequence
QSVLTQPPSVSGAPGQRVTISCTGSSSNIGARYDVHWYQQLPGTAPRLLISANYDRPSGVPD
RFSGSKSGTSASLAITGLQAEDEADYYCQSYDSSVSAWVFGGGTKVTVLGSRGGGSGGG
GSGGGGSLEMAEVQLVQSGAEVKEPGASVRISCQASGYNFISYYMHWVRQAPGQGLEW
MGTINPGSGETDYSQKLQGRVTMTRDPSTGTFDMGLSSLTSGDTAVYYCATGLIRGASDA
FNIWGRGTMVTVSSTSGQAGQHHHHHHGAYPYDVPDYAS [SEQ ID NO: 874]

TABLE 218

ET200-116
DNA Sequence
cagcctgtgctgactcagccaccctcagtgtccgtgtccccaggacagacggccgccatccctgttctggagataagttgggggataaatttg
cttcctggtatcagcagaagccaggccagtcccctgtgctggtcatctatcaagatactaagcggccctcagggatccctgagcgattctctggc
tccaactctgggaacacagccactctgaccatcagcgggacccaggctatggatgaggctgactattactgtcagacgtgggccagcggcatt
gtggtgttcggcggagggaccaagctgaccgtcctaggttctagaggtggtggtggtagcggcggcggcggctctggtggtggtggatcccT
cgagatggcccaggtacagctgcagcagtcaggtccaggactggtgaagccctcgcagaccctctcactcacctgtgccatctccggggaca
gtgtctctagcaacagtgctgcttggaactggatcaggcagtccccatcgagaggccttgagtggctgggaaggacatactacaggtccaagt
ggtataatgattatgcagtatctgtgaaaagtcgaataaccatcaaccagacacatccaagaaccagttctccctgcagctgaactctgtgact
cccgaggacacggctgtgtattactgtgcaagagagcgcagtggctggaagggatttgactactggggccagggaaccctggtcaccgtctcct
caactagtggccaggccggccagcaccatcaccatcaccatggcgcataccgtacgacgttccggactacgcttct [SEQ ID NO:
875]

Amino Acid Sequence
QPVLTQPPSVSVSPGQTAAIPCSGDKLGDKFASWYQQKPGQSPVLVIYQDTKRPSGIPERFS
GSNSGNTATLTISGTQAMDEADYYCQTWASGIVVFGGGTKLTVLGSRGGGGSGGGGSGG
GGSLEMAQVQLQQSGPGLVKPSQTLSLTCAISGDSVSSNSAAWNWIRQSPSRGLEWLGRT
YYRSKWYNDYAVSVKSRITINPDTSKNQFSLQLNSVTPEDTAVYYCARERSGWKGFDYW
GQGTLVTVSSTSGQAGQHHHHHHGAYPYDVPDYAS [SEQ ID NO: 876]

TABLE 219

ET200-117
DNA Sequence
gatgttgtgatgactcagtctccaccctccctgtccgtcacccctggagagccggcctccatcacctgcaggtctagtcagagcctcctggaaag
aaatgcatacaactacttggattggtacctgcagaggccaggacagtctccacagctcctgatctacttgggttctaatcgggccgccggggtcc
ctgacaggttcagtggcagtggatcaggcacagagattttcactgaaaatcagagagtggagcctgaggatgttggggtttattactgcatgcaa
gctctacaagctccgttcactttcggcggagggaccaaggtggagatcaaacgttctagaggtggtggtggtagcggcggcggcggctctggt
ggtggtggatcccTcgagatggccgaagtgcagctggtgcagtctggggaggcttggtacagcctggggggtccctgagactctcctgtgc
agcctctggattcaccttTagcagctatgccatgagctgggtccgccaggctccagggaaggggctggagtgggtctcagctattagtggtagt
ggtggtagcacatactacgcagactccgtgaagggccggttcaccatctccagagacaattccaagaacacgctgtatctgcaaatgaacagc
ctgagagccgaggacacggccgtatattactgtgcgaaatggggcccgtttcaggatgcttttgatatctggggccaagggacaatggtcaccg
tctccttcaactagtggccaggccggccagcaccatcaccatcaccatggcgcataccgtacgacgttccggactacgcttct [SEQ ID
NO: 877]

Amino Acid Sequence
DVVMTQSPPSLSVTPGEPASITCRSSQSLLERNAYNYLDWYLQRPGQSPQLLIYLGSNRAA
GVPDRFSGSGSGRDFTLKISRVEPEDVGVYYCMQALQAPFTFGGGTKVEIKRSGGGGSG
GGGSGGGGSLEMAEVQLVQSGGGLVQPGGSLRLSCAASGFTFSSYAMSWVRQAPGKGLE
WVSAISGSGGSTYYADSVKGRFTISRDNSKNTLYLQMNSLRAEDTAVYYCAKWGPFQDA
FDIWGQGTMVTVSSTSGQAGQHHHHHHGAYPYDVPDYAS [SEQ ID NO: 878]

TABLE 220

ET200-118
DNA Sequence
caggctgtgctgactcagcctgcctccgtgtctgggtctcctggacagtcgatcaccatctcctgcactggaaccagcagtgacgttggtggtta
taactatgtctcctggtaccaacagcacccgggcaaagcccccaaactcatgatttatgaggtcagtaatcggccctcaggggtttctaatcgct
tctctggctccaagtctggcaacacggcctcctgaccatctctgggctccaggctgaggacgaggctgattattactgcagctcatatacaagc
agcagcacccttatgtcttcggagcagggaccaaggtcaccgtcctaggttctagaggtggtggtggtagcggcggcggcggctctggtggtg
tgggatcccTcgagatggccgaggtgcagctggtggagtctggggggaggcttggtacagcctggcaggtccctgagactctcctgtgcagcctc
tggattcacctttgatgattatgccatgcactgggtccggcaagctccagggaagggcctggagtgggtctcaggtattagttggaatagtggta
gcataggctatgcggactctgtgaagggccgattcaccatctccagagacaacgccaagaactccctgtatctgcaaatgaacagtctgagagc
tgaggacacggccttgtattactgtgcaaaagccaggtggacagcagtggcatcagaccaccactttgactactggggccagggaacgctggt
caccgtctcctcaactagtggccaggccggccagcaccatcaccatcaccatggcgcataccgtacgacgttccggactacgcttct [SEQ
ID NO: 879]

Amino Acid Sequence
QAVLTQPASVSGSPGQSITISCTGTSSDVGGYNYVSWYQQHPGKAPKLMIYEVSNRPSGVS
NRFSGSKSGNTASLTISGLQAEDEADYYCSSYTSSSTPYVFGAGTKVTVLGSRGGGGSGGG
GSGGGGSLEMAEVQLVESGGGLVQPGRSLRLSCAASGFTFDDYAMHWVRQAPGKGLEW
VSGISWNSGSIGYADSVKGRFTISRDNAKNSLYLQMNSLRAEDTALYYCAKARWTAVASD
HHFDYWGQGTLVTVSSTSGQAGQHHHHHHGAYPYDVPDYAS [SEQ ID NO: 880]

TABLE 221

ET200-119
DNA Sequence
caggctgtgcttactcagccaccctcagcgtctgggaccccgggcagagggtcaccatctcttgttctggaagcagctccaacatcggaagta
atactgtaaactggtaccagcagctcccaggaacggcccccaaactcctcatctatagtaataatcagcggccctcaggggtccctgaccgatt
ctctggctccaagtctggcacctcagcctccctggccatcagtgggctccagtctgaggatgaggctgattattactgtgcagcatgggatgaca
gcctgaatggttatgtcttcggaactgggaccaagctgaccgtcctaggtctagaggtggtggtggtagcggcggcggcggctctggtggtg
gtggatccctcgagatggccgaggtgcagctggtgcagtctggggctgaggtgaagaagcctgggtcctcggtgaaggtctcctgcaaggctt
ctggaggcaccttcagcagctatgctatcagctgggtgcgacaggcccctggacaagggcttgagtggatgggagggatcatccctatctttgg
tacagcaaactacgcacagaagttccagggcagagtcacgattaccgcggacgaatccacgagcacagcctacatggagctgagcagcctg
agatctgaggacacggccgtgtattactgtgcgagagattgggactacatggacgtctggggccaagggaccacggtcaccgtctcctcaact
agtggccaggccggccagcaccatcaccatcaccatggcgcataccgtacgacgttccggactacgcttct [SEQ ID NO: 881]

Amino Acid Sequence
QAVLTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKLTVLGSRGGGGSGGGG
SGGGGSLEMAEVQLVQSGAEVKKPGSSVKVSCKASGGTFSSYAISWVRQAPGQGLEWMG
GIIPIFGTANYAQKFQGRVTITADESTSTAYMELSSLRSEDTAVYYCARDWDYMDVWGKG
TTVTVSSTSGQAGQHHHHHHGAYPYDVPDYAS [SEQ ID NO: 882]

TABLE 222

ET200-120
DNA Sequence
tcctatgagctgactcagccaccctcagcgtctgggaccccgggcagagggtcaccatctcttgttctggaagcagctccaacatcggaagta
atactgtaaactggtaccagcagctcccaggaacggcccccaaactcctcatctatagtaataatcagcggccctcaggggtccctgaccgatt
ctctggctccaagtctggcacctcagcctccctggccatcagtgggctccagtctgaggatgaggctgattattactgtgcagcatgggatgaca
gcctgaatggttatgtcttcggaactgggaccaaggtcaccgtcctaggtctagaggtggtggtggtagcggcggcggcggctctggtggtg
gtggatccctcgagatggccgaggtgcagctggtggagtctggagctgaggtgaagaagcctggggcctcagtgaaggtctcctgcaaggct
tctggttacaccttaccagctatggtatcagctgggtgcgacaggcccctggacaagggcttgagtggatgggatggatcagcgcttacaatg
gtaacacaaactatgcacagaagctccagggcagagtcaccatgaccgaccacacatccacgagcacagcctacatggagctgagcagcct
gagatctgacgacacggccgtgtattactgtgcgagagacctatccggggagctaaccgcattactactactactacggtatggacgtctggg
gccaagggaccacggtcaccgtctcctcaactagtggccaggccggccagcaccatcaccatcaccatggcgcataccgtacgacgttccg
gactacgcttct [SEQ ID NO: 883]

Amino Acid Sequence
SYELTQPPSASGTPGQRVTISCSGSSSNIGSNTVNWYQQLPGTAPKLLIYSNNQRPSGVPDR
FSGSKSGTSASLAISGLQSEDEADYYCAAWDDSLNGYVFGTGTKVTVLGSRGGGGSGGGG
SGGGGSLEMAEVQLVESGAEVKKPGASVKVSCKASGYTFTSYGISWVRQAPGQGLEWMG
WISAYNGNTNYAQKLQGRVTMTTDTSTSTAYMELRSLRSDDTAVYYCARDLSRGANPHY
YYYYGMDVWGQGTTVTVSSTSGQAGQHHHHHHGAYPYDVPDYAS [SEQ ID NO: 884]

TABLE 223

ET200-121
DNA Sequence
cagtctgtgttgacgcagccgccctcagtgtctggggccccagggcagagggtcaccgtctcctgcactgggagcagatccaacatcggggc
aggatatgatgtacactggtaccagcaacttccaggaacagcccccaaactcctcatctatggaaatagtaatcggcctccaggggtccctgac
cgattctctgggtctaagtctggcacctcagcctccctggtcatcactgggctccaggctgaggatgccgctgattattactgccagtcctatga
caacactgtgcgtgaatcacccttatgtcttcggaactgggaccaaggtcaccgtcctaggttctagaggtggtggtggtagcggcggcggcggct
ctggtggtggtggatccctcgagatggccgaggtccagctggtacagtctggggctgaggtgaagaagcctggggcctcagtgaaggtctcct
gcaaggtttccggatacaccctcactgaattatccatgcactgggtgcgacaggctcctggaaaagggcttgagtggatgggaggttttgatcct
gaagatggtgaaacaatctacgcacagaagttccagggcagagtcaccatgaccgaggacacatctacagacacagcctacatggagctgag
cagcctgagatctgaggacacggccgtgtattactgtgcaacagagagtaatttagtgtcccggcactactactactacggtatggacgtctggg
gccaagggaccacggtcaccgtctcctcaactagtggccaggccggccagcaccatcaccatcaccatggcgcataccgtacgacgttccg
gactacgcttct [SEQ ID NO: 885]

Amino Acid Sequence
QSVLTQPPSVSGAPGQRVTVSCTGSRSNIGAGYDVHWYQQLPGTAPKLLIYGNSNRPPGVP
DRFSGSKSGTSASLVITGLQAEDAADYYCQSYDNTVRESPYVFGTGTKVTVLGSRGGGGS
GGGGSGGGGSLEMAEVQLVQSGAEVKKPGASVKVSCKVSGYTLTELSMHWVRQAPGKG
LEWMGGFDPEDGETIYAQKFQGRVTMTEDTSTDTAYMELSSLRSEDTAVYYCATESNLVS
RHYYYYGMDVWGQGTTVTVSSTSGQAGQHHHHHHGAYPYDVPDYAS [SEQ ID NO: 886]

TABLE 224

ET200-122
DNA Sequence
ctgcctgtgctgactcagccaccctcagcgtctgggaccccgggcagagggtcaccatctcttgttctggaaccagctccaacatcggaagta
attctgtagactggtaccagcagctcccaggaacggcccccaaactcctcatctatagtaataatcagcggccctcaggggtccctgaccgaat
ctctggctccaagtctggcacctcagcctccctggccatcagtgggctccagtctgaggatgaggctgattattactgtgcagcatgggatgaca
gcctgaatggttatgtcttcggaactgggaccaaggtcaccgtcctaggttctagaggtggtggtggtagcggcggcggcggctctggtggtg
gtggatccctcgagatggccgaagtgcagctggtgcagtctggggctgaggtgaagaagcctggggcctcagtgaaggtctcctgcaaggct
tctggatacacctttaccggctactatatgcactgggtgcgacaggcccctggacaagggcttgagtggatgggatggatcaaccctaacagtg
gtggcacaaactatgcacagaagtttcagggcagggtcaccatgaccagggacacgtccatcagcacagcctacatggagctgagcaggctg
agatctgacgacacggccgtgtattactgtgcgagagattacggatactatggttcggggagttattcgagcggcccccttttactactactacgg
tatggacgtctggggccaagggaccacggtcaccgtctcctcaactagtggccaggccggccagcaccatcaccatcaccatggcgcataccc
gtacgacgttccggactacgcttct [SEQ ID NO: 887]

Amino Acid Sequence
LPVLTQPPSASGTPGQRVTISCSGTSSNIGSNSVDWYQQLPGTAPKLLIYSNNQRPSGVPDRI
SGSKSGTSASLAISGLQSEDEADYYCAAWDDSLNGYVFGTGTKVTVLGSRGGGGSGGGGS
GGGGSLEMAEVQLVQSGAEVKKPGASVKVSCKASGYTFTGYYMHWVRQAPGQGLEWM
GWINPNSGGTNYAQKFQGRVTMTRDTSISTAYMELSRLRSDDTAVYYCARDYGYYGSGS
YSSGPLYYYYGMDVWGQGTTVTVSSTSGQAGQHHHHHHGAYPYDVPDYAS [SEQ ID
NO: 888]

TABLE 225

ET200-123
DNA Sequence
caggctgtgctgactcagccaccctcagcgtctgggaccccgggcagagggtcaccatctcttgttctggaagcagctccaacatcggaagt
aatactgtaaactggtaccagcagctcccaggaacgccccccaaactcctcatgtataataatgatcagcggccctcaggggtccctgaccgat
tctctggctccaagtctggcacctcagcctccctggccatcagtgggctccagtctgaggatgaggctgattattactgtgcagcatgggatgac
agcctcaatggttatgtcttcggacctgggaccaaggtcaccgtcctaggttctagaggtggtggtggtagcggcggcggcggctctggtggtg
gtggatccctcgagatggccaggtgcagctggtgagtctggagctgaggtgaagaagcctggggcctcagtgaaggtctcctgcaaggct
tctggttacacctttaccagctatggtatcagctgggtgcgacaggcccctggacaagggcttgagtggatgggatggatcagcgcttacaatg
gtaacacaaactatgcacagaagctccagggcagagtcaccatgaccacagacacatccacgagcacagcctacatggagctgaggagcct
gagatctgacgacacggccgtgtattactgtgcgagagaccatctcggggagctaacccgcattactactactacggtatggacgtctggg
gccaagggaccacggtcaccgtctcctcaactagtggccaggccggccagcaccatcaccatcaccatggcgcataccc gtacgacgttccg
gactacgcttct [SEQ ID NO: 889]

Amino Acid Sequence
QAVLTQPPSASGTPGQRVTISCSGSSSNIGSNTVNWYQQLPGTAPKLLMYNNDQRPSGVPD
RFSGSKSGTSASLAISGLQSEDEADYYCAAWDDSLNGYVFGPGTKVTVLGSRGGGGSGGG
GSGGGGSLEMAQVQLVESGAEVKKPGASVKVSCKASGYTFTSYGISWVRQAPGQGLEW
MGWISAYNGNTNYAQKLQGRVTMTTDTSTSTAYMELRSLRSDDTAVYYCARDLSRGANP
HYYYYYGMDVWGQGTTVTVSSTSGQAGQHHHHHHGAYPYDVPDYAS [SEQ ID NO: 890]

TABLE 226

ET200-125
DNA Sequence
aattttatgctgactcagccccacgctgtgtcggagtctccggggaagacggtaaccatctcctgcacccgcagcagtggcagtattgccagca
actatgtgcagtggtaccagcagcgcccgggcagttcccccgcactgtgatttatgaggataatcaaagaccctctggggtccctggtcggttc
tctggctccatcgacagctcctccaactctgctccctcaccatctctggactgaagactgaggacgaggctgactactactgtcagtcttatga
ttccaccagtgtgcttttcggcggagggaccaagctgaccgtcctaggttctagaggtggtggtggtagcggcggcggcggctctggtggtggtg
gatccctcgagatggccgaggtccagctggtgcagtctggggctgaggtgaagaagccagggtcctcggtgaaggtctcctgcaaggcctcg
ggaggcaccttcagcagcaattctctcagctgggtgcgacaggcccctggacaagggcttgagtggatgggaaggatcttccctatcctgggt
ataacaaactatgcacagaagttccagggcagagtcacgattaccgcggacaaatccacgagcacagcctacatggagctgagcagcctgag
atctgaggacacggccgtctattactgtgcgagaggaaactaccaatggtatgatgcttttgatatctggggccaagggacaatggtcaccgtct
cttcaactagtggccaggccggccagcaccatcaccatcaccatggcgcataccc gtacgacgttccggactacgcttct [SEQ ID NO:
891]

Amino Acid Sequence
NFMLTQPHAVSESPGKTVTISCTRSSGSIASNYVQWYQQRPGSSPRTVIYEDNQRPSGVPGR
FSGSIDSSSNSASLTISGLKTEDEADYYCQSYDSTSVLFGGGTKLTVLGSRGGGGSGGGGSG
GGGSLEMAEVQLVQSGAEVKKPGSSVKVSCKASGGTFSSNSLSWVRQAPGQGLEWMGRI
FPILGITNYAQKFQGRVTITADKSTSTAYMELSSLRSEDTAVYYCARGNYQWYDAFDIWG
QGTMVTVSSTSGQAGQHHHHHHGAYPYDVPDYAS [SEQ ID NO: 892]

TABLE 227

ET200-005
DNA Sequence
cagcctgtgctgactcagccaccctcagtgtcagtggtcccaggaaagacggccaggattacctgtgggggaaaaaacattggaagtaaaagt
gtgcactggtaccagcagaagccaggccaggcccctgtggtggtcatccattatgatagtgaccggccctcagggatccctgagcgattctctg
gctccaactctgggaacacggccaccctgaccatcagcagggtcgaagccggggatgaggccgactattactgtcaggtgtgggatagtagt
agtgatcatccttatgtcttcggaactgggaccaaggtcaccgtcctaggttctagaggtggtggtggtagcggcggcggcggctctggtggtg
gtggatccctcgagatggcccaggtgcagctggtgcagtctggagctgaggtgaagaagcctggggcctcagtgaaggtctcctgcaaggct
tctggttacacctttaccaactatggtatcagctgggtgcgacaggcccctggacaagggcttgagtggatgggatggatcagcgcttacaatgg
taacacaaactatgcacataagctccagggcagagtcaccatgaccacagacacatccacgagcacagccaacatggagctgaggagcctg
agacctgacgacactgccgtgtattactgtgcgcgctcttacttcggttctcatgattactgggtcaaggtactctggtgaccgtctcctcaac
tagtggccaggccggccagcaccatcaccatcaccatggcgcataccgtacgacgttccggactacgcttct [SEQ ID NO: 893]

Amino Acid Sequence
QPVLTQPPSVSVVPGKTARITCGGKNIGSKSVHWYQQKPGQAPVVVIHYDSDRPSGIPERFS
GSNSGNTATLTISRVEAGDEADYYCQVWDSSSDHPYVFGTGTKVTVLGSRGGGGSGGGG
SGGGGSLEMAQVQLVQSGAEVKKPGASVKVSCKASGYTFTNYGISWVRQAPGQGLEWM
GWISAYNGNTNYAHKLQGRVTMTTDTSTSTANMELRSLRPDDTAVYYCARSYFGSHDY
WGQGTLVTVSSTSGQAGQHHHHHHGAYPYDVPDYAS [SEQ ID NO: 894]

TABLE 228

ET200-124
DNA Sequence
tcctatgtgctgactcagccaccctcggtgtcagtggccccaggaaagacggccaggatttcctgtgggggaaacgacattggaagtaaaagt
gttttctggtatcagcagaggccaggccaggcccctgtgttggtcgtctatgatgatagcgaccggccctcagggctccctgagcgattctctgg
cttcaactctgggaacacggccaccctgaccatcagcagggtcgaagccggggatgaggccgactattactgtcaagtgtgggatagtagtag
tgatcattatgtcttcggaactgggaccaaggtcaccgtcctaggttctagaggtggtggtggtagcggcggcggcggctctggtggtggtgga
tccctcgagatggcccaggtgcagctggtggagtctgggggaggcttggtacagcctggcaggtcccgagactctcctgtgcagcctctgga
ttcacctttgatgattatgccatgcactgggtccggcaagctccagggaagggcctggagtgggtctcaggtattagttggaatagtggtagcat
aggctatgcggactctgtgaagggccgattcaccatctccagagacaacgccaagaactccctgtatctgcaaatgaacagtctgagagctgag
gacacggccttgtattactgtgcaaaagatataacctatggttcggggagttatgtgcttttgatatctggggccaagggacaatggtcaccgt
ctcttcaactagtggccaggccggccagcaccatcaccatcaccatggcgcataccgtacgacgttccggactacgcttct [SEQ ID NO: 895]

Amino Acid Sequence
SYVLTQPPSVSVAPGKTARISCGGNDIGSKSVFWYQQRPGQAPVLVVYDDSDRPSGLPERF
SGFNSGNTATLTISRVEAGDEADYYCQVWDSSSDHYVFGTGTKVTVLGSRGGGGSGGGG
SGGGGSLEMAQVQLVESGGGLVQPGRSLRLSCAASGFTFDDYAMHWVRQAPGKGLEWV
SGISWNSGSIGYADSVKGRFTISRDNAKNSLYLQMNSLRAEDTALYYCAKDITYGSGSYGA
FDIWGQGTMVTVSSTSGQAGQHHHHHHGAYPYDVPDYAS [SEQ ID NO: 896]

CDR Sequences of Exemplary Anti-FcRL5 Antibodies

TABLE 229

| Antibody | V$_H$CDR1 | V$_H$CDR2 | V$_H$CDR3 |
| --- | --- | --- | --- |
| ET200-001 | GGSFSGYY [SEQ ID NO: 309] | INHSGST [SEQ ID NO: 310] | AREGPYDGFDS [SEQ ID NO: 311] |
| ET200-002 | GYPFNKYD [SEQ ID NO: 315] | IIPIFRTT [SEQ ID NO: 316] | AREWFYWDI [SEQ ID NO: 317] |
| ET200-003 | GFTFSSYG [SEQ ID NO: 321] | ISHDGSNK [SEQ ID NO: 322] | ARSNQWSGYFSFDY [SEQ ID NO: 323] |
| ET200-005 | GYTFTNYG [SEQ ID NO: 326] | ISAYNGNT [SEQ ID NO: 327] | ARSYFGSHDY [SEQ ID NO: 328] |
| ET200-006 | GYTFTTYG [SEQ ID NO: 332] | INTYNGHT [SEQ ID NO: 333] | ARVIYGSGDY [SEQ ID NO: 334] |
| ET200-007 | GYSISSGYF [SEQ ID NO: 335] | IYHSRST [SEQ ID NO: 336] | ARGYGYFDY [SEQ ID NO: 337] |
| ET200-008 | GFTFGDYG [SEQ ID NO: 340] | INWNGGST [SEQ ID NO: 341] | ARSKYNFHVYYDY [SEQ ID NO: 342] |
| ET200-009 | GYTFTSYG [SEQ ID NO: 346] | ISAYNGNT [SEQ ID NO: 327] | ARSSGNMVSWKDM [SEQ ID NO: 347] |
| ET200-010 | GYTFTSYG [SEQ ID NO: 346] | ISAYNGNT [SEQ ID NO: 327] | ARGAVAYHD [SEQ ID NO: 351] |

TABLE 229-continued

```
ET200-011  GGTLSSYA          IIPMFGTA          ARGVHYASFDH
           [SEQ ID NO: 354]  [SEQ ID NO: 355]  [SEQ ID NO: 356]

ET200-012  GFPFNIFG          ISGYNGNT          ARGAYGGMDT
           [SEQ ID NO: 360]  [SEQ ID NO: 361]  [SEQ ID NO: 362]

ET200-013  GYMFTSYG          ISANNGKT          ARHIGGSYFDR
           [SEQ ID NO: 366]  [SEQ ID NO: 367]  [SEQ ID NO: 368]

ET200-014  GFTFSSYA          ISGSDGST          ARSHEANLVGDW
           [SEQ ID NO: 372]  [SEQ ID NO: 373]  [SEQ ID NO: 374]

ET200-015  GYTFTSYG          ISAYNGNT          ARWGGFGAVDH
           [SEQ ID NO: 346]  [SEQ ID NO: 327]  [SEQ ID NO: 376]

ET200-016  GFTFSSYS          ISSSSSYI          ARGQGYDY
           [SEQ ID NO: 378]  [SEQ ID NO: 379]  [SEQ ID NO: 380]

ET200-017  GGSFSGYY          INHSGST           ARYYPGMDM
           [SEQ ID NO: 309]  [SEQ ID NO: 310]  [SEQ ID NO: 384]

ET200-018  GYTLNELS          FDPEDGET          ARGGYGDS
           [SEQ ID NO: 387]  [SEQ ID NO: 388]  [SEQ ID NO: 389]

ET200-019  GGTFSSDA          IIPMFGTA          AREGYYYPSAYLGSVL
           [SEQ ID NO: 393]  [SEQ ID NO: 355]  NDISSVYDE
                                               [SEQ ID NO: 394]

ET200-020  GYTFTSYG          ISAYNGNT          ARSMTSFDY
           [SEQ ID NO: 346]  [SEQ ID NO: 327]  [SEQ ID NO: 396]

ET200-021  GYTFTSYG          ISAYNGNT          ARSVYDLDT
           [SEQ ID NO: 346]  [SEQ ID NO: 327]  [SEQ ID NO: 400]

ET200-022  GFTFDDYA          ISWNSGSI          ARYRQVGSAYDS
           [SEQ ID NO: 403]  [SEQ ID NO: 404]  [SEQ ID NO: 405]

ET200-023  GYTFTSYG          ISAYNGNT          ARYWGFGVSDR
           [SEQ ID NO: 346]  [SEQ ID NO: 327]  [SEQ ID NO: 408]

ET200-024  GGTFSSYA          IIPIFGTA          ARYNYYYDS
           [SEQ ID NO: 411]  [SEQ ID NO: 412]  [SEQ ID NO: 413]

ET200-025  GGTFSSYA          IIPIFGTA          ARYWGYDSYDE
           [SEQ ID NO: 411]  [SEQ ID NO: 412]  [SEQ ID NO: 415]

ET200-026  GGTFSSYA          IIPIFGTA          ARNNHYYNDY
           [SEQ ID NO: 411]  [SEQ ID NO: 412]  [SEQ ID NO: 349]

ET200-027  GYTFTDYY          VDPEDGET          ARYWSYSFDYLYMPEG
           [SEQ ID NO: 420]  [SEQ ID NO: 421]  NDW
                                               [SEQ ID NO: 422]

ET200-028  GYNFLNYG          ISTYTGNT          ARDLYYYEGVDY
           [SEQ ID NO: 425]  [SEQ ID NO: 426]  [SEQ ID NO: 427]

ET200-029  GFTFSSYA          ISYDGSNK          ARSYFTSGFYDY
           [SEQ ID NO: 372]  [SEQ ID NO: 431]  [SEQ ID NO: 432]

ET200-030  GYTLTELS          FDPEDGET          ARMSSMYYD
           [SEQ ID NO: 436]  [SEQ ID NO: 388]  [SEQ ID NO: 437]

ET200-031  GFTVSDYY          ISGSGNSI          ARSTKFDY
           [SEQ ID NO: 440]  [SEQ ID NO: 441]  [SEQ ID NO: 442]

ET200-032  GYSFTNYW          IYPGDSDT          ARSTGSSHMSDE
           [SEQ ID NO: 444]  [SEQ ID NO: 445]  [SEQ ID NO: 446]

ET200-033  GGSFSGYY          ITHSGRS           ARSSIMSDY
           [SEQ ID NO: 309]  [SEQ ID NO: 450]  [SEQ ID NO: 451]

ET200-034  GGTFSSYA          IIPIFGTA          ARGSALDHYDR
           [SEQ ID NO: 411]  [SEQ ID NO: 412]  [SEQ ID NO: 453]

ET200-035  GGTFSSYA          IIPIFGTA          ARYNYYFNDY
           [SEQ ID NO: 411]  [SEQ ID NO: 412]  [SEQ ID NO: 456]

ET200-037  GYTFTSYG          ISAYNGNT          ARSMFGAHDS
           [SEQ ID NO: 346]  [SEQ ID NO: 327]  [SEQ ID NO: 458]
```

TABLE 229-continued

```
ET200-038  GGTFSSYA         IIPIFGTA         ARGASFDRHDN
           [SEQ ID NO: 411] [SEQ ID NO: 412] [SEQ ID NO: 459]

ET200-039  GGTFSSYA         IIPIFGTA         ARSNYYYNDY
           [SEQ ID NO: 411] [SEQ ID NO: 412] [SEQ ID NO: 463]

ET200-040  GYTLTELS         FDPEDGET         ARYSGVYYD
           [SEQ ID NO: 436] [SEQ ID NO: 388] [SEQ ID NO: 464]

ET200-041  GGTFSSYA         MNPNSGNT         ARYYSYGYD
           [SEQ ID NO: 411] [SEQ ID NO: 466] [SEQ ID NO: 467]

ET200-042  GDSVSTNSVA       TYYRSKWSN        ARSSSWYQIFDY
           [SEQ ID NO: 471] [SEQ ID NO: 472] [SEQ ID NO: 473]

ET200-043  GFTFSSYA         ISGSGGST         ARSGAYWDYSVYDE
           [SEQ ID NO: 372] [SEQ ID NO: 475] [SEQ ID NO: 476]

ET200-044  GGSISSSNW        IYHSGSP          ARMTTHTFGYDA
           [SEQ ID NO: 480] [SEQ ID NO: 481] [SEQ ID NO: 482]

ET200-045  GYTFTSYG         ISAYNGNT         ARGVHLDW
           [SEQ ID NO: 346] [SEQ ID NO: 327] [SEQ ID NO: 486]

ET200-069  GGSFSGYY         INHSGST          ARLYEGGYHGWGSWLSSDS
           [SEQ ID NO: 309] [SEQ ID NO: 310] [SEQ ID NO: 489]

ET200-078  GGSFSGYY         INHSGST          AREGAFDAFDI
           [SEQ ID NO: 309] [SEQ ID NO: 310] [SEQ ID NO: 492]

ET200-079  GFTFDDYA         ISWNSGSI         ANGDSNYYYGMDV
           [SEQ ID NO: 403] [SEQ ID NO: 404] [SEQ ID NO: 494]

ET200-081  GFTFDDYA         ISGDGGST         AKDRAAAGYYYYGMDV
           [SEQ ID NO: 403] [SEQ ID NO: 496] [SEQ ID NO: 497]

ET200-097  GFTFNDYA         ISWSGNNI         AKDSIRYGITWGGFDY
           [SEQ ID NO: 500] [SEQ ID NO: 501] [SEQ ID NO: 502]

ET200-098  GFTFDDYA         INWDGGST         AKGMGLRAFDY
           [SEQ ID NO: 403] [SEQ ID NO: 506] [SEQ ID NO: 507]

ET200-099  GYTFSWYA         INAGNGNT         ARPDNYGSGGDVFDI
           [SEQ ID NO: 510] [SEQ ID NO: 511] [SEQ ID NO: 512]

ET200-100  GFTFSSYE         ISSSGSTI         ARWDYGMDV
           [SEQ ID NO: 515] [SEQ ID NO: 516] [SEQ ID NO: 517]

ET200-101  GYTFTWYA         INAGSGNT         ARPNNYGSGGDVFDI
           [SEQ ID NO: 520] [SEQ ID NO: 521] [SEQ ID NO: 522]

ET200-102  GYTFTNYA         INGGNGNT         AKPEETAGTIHFDY
           [SEQ ID NO: 525] [SEQ ID NO: 526] [SEQ ID NO: 527]

ET200-103  GGTFSSYA         IIPIFGTA         AGEGYYDSSGYSNGDAFDI
           [SEQ ID NO: 411] [SEQ ID NO: 412] [SEQ ID NO: 529]

ET200-104  GFTFSSYE         ISSSGSTI         ARWDYGMDV
           [SEQ ID NO: 515] [SEQ ID NO: 516] [SEQ ID NO: 517]

ET200-105  GFTFDDYA         ISWNSGSI         AKDRGGGVIVKDAFDI
           [SEQ ID NO: 403] [SEQ ID NO: 404] [SEQ ID NO: 532]

ET200-106  GYNFLNYG         ISTYTGNT         ARQQGGGWYDV
           [SEQ ID NO: 425] [SEQ ID NO: 426] [SEQ ID NO: 536]

ET200-107  GYTFTSYT         ISTYNGLT         VREGSPDYGDFASFDY
           [SEQ ID NO: 537] [SEQ ID NO: 538] [SEQ ID NO: 539]

ET200-108  GYTFTSYT         ISTYNGLT         VREGSPDYGDFASFDY
           [SEQ ID NO: 537] [SEQ ID NO: 538] [SEQ ID NO: 539]

ET200-109  GGTFSSYA         IIPIFGTA         ARDPAYGDYEYDAFDI
           [SEQ ID NO: 411] [SEQ ID NO: 412] [SEQ ID NO: 543]

ET200-110  GGTFSSYA         IIPIFGTA         ARGAGFDAFDI
           [SEQ ID NO: 411] [SEQ ID NO: 412] [SEQ ID NO: 546]
```

TABLE 229-continued

| Antibody | V_H CDR1 | V_H CDR2 | V_H CDR3 |
|---|---|---|---|
| ET200-111 | GGSFSGYY [SEQ ID NO: 309] | INHSGST [SEQ ID NO: 310] | AREGLDAFDI [SEQ ID NO: 550] |
| ET200-112 | GGSFSGYY [SEQ ID NO: 309] | INHSGST [SEQ ID NO: 310] | AREGLDAFDI [SEQ ID NO: 550] |
| ET200-113 | GYSFTSYT [SEQ ID NO: 551] | VSTYNGLR [SEQ ID NO: 552] | VREGSPDYGDFAAFDY [SEQ ID NO: 553] |
| ET200-114 | GGSFSGYY [SEQ ID NO: 309] | INHSGST [SEQ ID NO: 310] | ARDGGGYFDY [SEQ ID NO: 555] |
| ET200-115 | GYNFISYY [SEQ ID NO: 559] | INPGSGET [SEQ ID NO: 560] | ATGLIRGASDAFNI [SEQ ID NO: 561] |
| ET200-116 | GDSVSSNSAA [SEQ ID NO: 565] | TYYRSKWYN [SEQ ID NO: 566] | ARERSGWKGFDY [SEQ ID NO: 567] |
| ET200-117 | GFTFSSYA [SEQ ID NO: 372] | ISGSGGST [SEQ ID NO: 475] | AKWGPFQDAFDI [SEQ ID NO: 570] |
| ET200-118 | GFTFDDYA [SEQ ID NO: 403] | ISWNSGSI [SEQ ID NO: 404] | AKARWTAVASDHHFDY [SEQ ID NO: 574] |
| ET200-119 | GGTFSSYA [SEQ ID NO: 411] | IIPIFGTA [SEQ ID NO: 412] | ARDWDYMDV [SEQ ID NO: 577] |
| ET200-120 | GYTFTSYG [SEQ ID NO: 346] | ISAYNGNT [SEQ ID NO: 327] | ARDLSRGANPHYYYYYGMDV [SEQ ID NO: 578] |
| ET200-121 | GYTLTELS [SEQ ID NO: 436] | FDPEDGET [SEQ ID NO: 388] | ATESNLSRHYYYYGMDV [SEQ ID NO: 579] |
| ET200-122 | GYTFTGYY [SEQ ID NO: 582] | INPNSGGT [SEQ ID NO: 583] | ARDGYYGSGSYSSGPLYYYYGMDV [SEQ ID NO: 584] |
| ET200-123 | GYTFTSYG [SEQ ID NO: 346] | ISAYNGNT [SEQ ID NO: 327] | ARDLSRGANPHYYYYYGMDV [SEQ ID NO: 578] |
| ET200-124 | GFTFDDYA [SEQ ID NO: 403] | ISWNSGSI [SEQ ID NO: 404] | AKDITYGSGSYGAFDI [SEQ ID NO: 587] |
| ET200-125 | GGTFSSNS [SEQ ID NO: 589] | IFPILGIT [SEQ ID NO: 590] | ARGNYQWYDAFDI [SEQ ID NO: 591] |

| Antibody | V_L CDR1 | V_L CDR2 | V_L CDR3 |
|---|---|---|---|
| ET200-001 | SSNIGSNT [SEQ ID NO: 312] | SNN [SEQ ID NO: 313] | AAWDDSLNGYV [SEQ ID NO: 314] |
| ET200-002 | SGSIASNY [SEQ ID NO: 318] | EDN [SEQ ID NO: 319] | QSYDSSNSVV [SEQ ID NO: 320] |
| ET200-003 | KLGTKY [SEQ ID NO: 324] | EDN [SEQ ID NO: 319] | QAWDSDTFVV [SEQ ID NO: 325] |
| ET200-005 | NIGSKS [SEQ ID NO: 329] | YDS [SEQ ID NO: 330] | QVWDSSSDHPYV [SEQ ID NO: 331] |
| ET200-006 | NIGSKS [SEQ ID NO: 329] | YDS [SEQ ID NO: 330] | QVWDSSSDHPYV [SEQ ID NO: 331] |
| ET200-007 | NIGSKT [SEQ ID NO: 338] | YDS [SEQ ID NO: 330] | QVWDSSSDHRV [SEQ ID NO: 339] |
| ET200-008 | SSDVGGYNY [SEQ ID NO: 343] | DVS [SEQ ID NO: 344] | SSYTSSSTSKV [SEQ ID NO: 345] |
| ET200-009 | NSNIGSNY [SEQ ID NO: 348] | RNN [SEQ ID NO: 349] | AAWDDSLSAYV [SEQ ID NO: 350] |
| ET200-010 | SSDVGGYNS [SEQ ID NO: 352] | DVS [SEQ ID NO: 344] | SSYTSSSTPLV [SEQ ID NO: 353] |
| ET200-011 | SSNISIYD [SEQ ID NO: 357] | GNN [SEQ ID NO: 358] | GTWDDSLSGGV [SEQ ID NO: 359] |
| ET200-012 | DSNIGNNY [SEQ ID NO: 363] | DVK [SEQ ID NO: 364] | GTWDSRLDAYV [SEQ ID NO: 365] |

TABLE 229-continued

```
ET200-013  TSNIGAGYD          TNN                GTWDSSLSAVV
           [SEQ ID NO: 369]   [SEQ ID NO: 370]   [SEQ ID NO: 371]

ET200-014  NIGSKS             YDS                QVWDSSSDHYV
           [SEQ ID NO: 329]   [SEQ ID NO: 330]   [SEQ ID NO: 375]

ET200-015  NIGSKS             YDS                QVWSDSSSDVV
           [SEQ ID NO: 329]   [SEQ ID NO: 330]   [SEQ ID NO: 377]

ET200-016  SLTDYH             ATN                NSRDSGTDEVL
           [SEQ ID NO: 381]   [SEQ ID NO: 382]   [SEQ ID NO: 383]

ET200-017  NIGSKS             DDS                QVWDSSSDHTV
           [SEQ ID NO: 329]   [SEQ ID NO: 385]   [SEQ ID NO: 386]

ET200-018  SSNIGRNG           NDN                AAWDDSLHGVV
           [SEQ ID NO: 390]   [SEQ ID NO: 391]   [SEQ ID NO: 392]

ET200-019  SGSIASNY           EDN                QSYDSSNSWV
           [SEQ ID NO: 318]   [SEQ ID NO: 319]   [SEQ ID NO: 395]

ET200-020  TSNIGNND           DNN                GTWDSSVSAS
           [SEQ ID NO: 397]   [SEQ ID NO: 398]   [SEQ ID NO: 399]

ET200-021  NSNIGNNY           DNN                GTWNTTVTPGYV
           [SEQ ID NO: 401]   [SEQ ID NO: 398]   [SEQ ID NO: 402]

ET200-022  SSNIGNNY           DNN                GTWDSSLGAPYV
           [SEQ ID NO: 406]   [SEQ ID NO: 398]   [SEQ ID NO: 407]

ET200-023  NIGSKS             ADS                QVWDSSSYHNYV
           [SEQ ID NO: 329]   [SEQ ID NO: 409]   [SEQ ID NO: 410]

ET200-024  SGSIASNY           EDN                QSYDSSNLWV
           [SEQ ID NO: 318]   [SEQ ID NO: 319]   [SEQ ID NO: 414]

ET200-025  QSISSY             AAS                QQSYSTPFT
           [SEQ ID NO: 416]   [SEQ ID NO: 417]   [SEQ ID NO: 418]

ET200-026  SGSIASNY           EDN                QSYDSSNWV
           [SEQ ID NO: 318]   [SEQ ID NO: 319]   [SEQ ID NO: 419]

ET200-027  SSNIGAGYD          GNN                QSYDSSLSDVV
           [SEQ ID NO: 423]   [SEQ ID NO: 358]   [SEQ ID NO: 424]

ET200-028  VSNIGSGA           SYS                ATWDDSVNG
           [SEQ ID NO: 428]   [SEQ ID NO: 429]   [SEQ ID NO: 430]

ET200-029  NIGSES             YDT                QVWDSSRDHVV
           [SEQ ID NO: 433]   [SEQ ID NO: 434]   [SEQ ID NO: 435]

ET200-030  SSNIGAGYD          GNS                QSYDSSLSGSYV
           [SEQ ID NO: 423]   [SEQ ID NO: 438]   [SEQ ID NO: 439]

ET200-031  NIGSKS             YDS                QVWDSSSDYV
           [SEQ ID NO: 329]   [SEQ ID NO: 330]   [SEQ ID NO: 443]

ET200-032  SSNVGSYT           NNN                AAWDDRLGGYV
           [SEQ ID NO: 447]   [SEQ ID NO: 448]   [SEQ ID NO: 449]

ET200-033  SGSIASNY           EDN                QSYDSSNHWV
           [SEQ ID NO: 318]   [SEQ ID NO: 319]   [SEQ ID NO: 452]

ET200-034  TSNIGAGYD          NNR                GTWDGSLTGAV
           [SEQ ID NO: 369]   [SEQ ID NO: 454]   [SEQ ID NO: 455]

ET200-035  SGSIASNY           EDN                QSYDSTNWV
           [SEQ ID NO: 318]   [SEQ ID NO: 319]   [SEQ ID NO: 457]

ET200-037  NIGSKS             YDS                QVWDSSSDHPYV
           [SEQ ID NO: 329]   [SEQ ID NO: 330]   [SEQ ID NO: 331]

ET200-038  SSNIGAGFD          ANS                QSYDSSLSGVV
           [SEQ ID NO: 460]   [SEQ ID NO: 461]   [SEQ ID NO: 462]

ET200-039  SGSIASNY           EDN                QSYDSSNWV
           [SEQ ID NO: 318]   [SEQ ID NO: 319]   [SEQ ID NO: 419]
```

TABLE 229-continued

```
ET200-040  SSNIGAGYD           GNS                 QSYDSSLSGYV
           [SEQ ID NO: 423]    [SEQ ID NO: 438]    [SEQ ID NO: 465]

ET200-041  SGSIADNF            NDD                 QSYDNNRGV
           [SEQ ID NO: 468]    [SEQ ID NO: 469]    [SEQ ID NO: 470]

ET200-042  SSNIGTGYF           GNN                 QSYDSSLSGYV
           [SEQ ID NO: 474]    [SEQ ID NO: 358]    [SEQ ID NO: 465]

ET200-043  SDSIANNY            EDV                 QSYHSDNRWV
           [SEQ ID NO: 477]    [SEQ ID NO: 478]    [SEQ ID NO: 479]

ET200-044  KLGDKY              QDN                 QAWDSSTYVA
           [SEQ ID NO: 483]    [SEQ ID NO: 484]    [SEQ ID NO: 485]

ET200-045  NIGSES              DDA                 QVWDRNSAQFV
           [SEQ ID NO: 433]    [SEQ ID NO: 487]    [SEQ ID NO: 488]

ET200-069  SSNIGSNY            SNN                 AAWDDSLSGYV
           [SEQ ID NO: 490]    [SEQ ID NO: 313]    [SEQ ID NO: 491]

ET200-078  SSNIGSNT            SNN                 AAWDDSLNGY
           [SEQ ID NO: 312]    [SEQ ID NO: 313]    [SEQ ID NO: 493]

ET200-079  SSNIGSNY            RNN                 AAWDDSLSGYL
           [SEQ ID NO: 490]    [SEQ ID NO: 349]    [SEQ ID NO: 495]

ET200-081  SSDIGGYNY           DVS                 ISYTRTWNPYV
           [SEQ ID NO: 498]    [SEQ ID NO: 344]    [SEQ ID NO: 499]

ET200-097  KLGEKY              QDT                 QAWDRGVV
           [SEQ ID NO: 503]    [SEQ ID NO: 504]    [SEQ ID NO: 505]

ET200-098  SNNVGNLG            RNN                 SAWDSSLSA
           [SEQ ID NO: 508]    [SEQ ID NO: 349]    [SEQ ID NO: 509]

ET200-099  SSNIGSNT            SND                 ASWDDSLNGRYV
           [SEQ ID NO: 312]    [SEQ ID NO: 513]    [SEQ ID NO: 514]

ET200-100  SGSIASNF            EDN                 QSYDTSNVV
           [SEQ ID NO: 518]    [SEQ ID NO: 319]    [SEQ ID NO: 519]

ET200-101  NSNIGSNY            SSS                 ATWDDSLNA
           [SEQ ID NO: 348]    [SEQ ID NO: 523]    [SEQ ID NO: 524]

ET200-102  SSNIGNNY            DNN                 GTWDSSLSAYV
           [SEQ ID NO: 406]    [SEQ ID NO: 398]    [SEQ ID NO: 528]

ET200-103  SGSIASNY            EDN                 QSYDSTITV
           [SEQ ID NO: 318]    [SEQ ID NO: 319]    [SEQ ID NO: 530]

ET200-104  SGSIASNY            EDN                 QSYDSSNVV
           [SEQ ID NO: 318]    [SEQ ID NO: 319]    [SEQ ID NO: 531]

ET200-105  RLTNKY              EDA                 QAWDSSVVV
           [SEQ ID NO: 533]    [SEQ ID NO: 534]    [SEQ ID NO: 535]

ET200-106  VSNIGSGA            SYN                 ATWDDSVNG
           [SEQ ID NO: 428]    [SEQ ID NO: 429]    [SEQ ID NO: 430]

ET200-107  NFNVGNND            DNN                 GTWDSSLNTGGV
           [SEQ ID NO: 540]    [SEQ ID NO: 398]    [SEQ ID NO: 541]

ET200-108  SSNIGNNY            DNN                 GTWDTSLSGFYV
           [SEQ ID NO: 406]    [SEQ ID NO: 398]    [SEQ ID NO: 542]

ET200-109  TSNIGSNT            NNN                 ATWDDSLSGVV
           [SEQ ID NO: 544]    [SEQ ID NO: 448]    [SEQ ID NO: 545]

ET200-110  SSNIGTNG            TND                 AVWDHSLNGPV
           [SEQ ID NO: 547]    [SEQ ID NO: 548]    [SEQ ID NO: 549]

ET200-111  SSNIGSNT            SNN                 AAWDDSLNGYV
           [SEQ ID NO: 312]    [SEQ ID NO: 313]    [SEQ ID NO: 314]

ET200-112  SSNIGSNT            SND                 AAWDDSLNGYV
           [SEQ ID NO: 312]    [SEQ ID NO: 513]    [SEQ ID NO: 314]
```

TABLE 229-continued

| | | | |
|---|---|---|---|
| ET200-113 | SSNIGNNY [SEQ ID NO: 406] | DNN [SEQ ID NO: 398] | GTWDSSLSAAYV [SEQ ID NO: 554] |
| ET200-114 | RSNIGTNI [SEQ ID NO: 556] | GS [SEQ ID NO: 557] | AAWDDSLNGPA [SEQ ID NO: 558] |
| ET200-115 | SSNIGARYD [SEQ ID NO: 562] | ANY [SEQ ID NO: 563] | QSYDSSVSAWV [SEQ ID NO: 564] |
| ET200-116 | KLGDKF [SEQ ID NO: 568] | QDT [SEQ ID NO: 504] | QTWASGIVV [SEQ ID NO: 569] |
| ET200-117 | QSLLERNAYNY [SEQ ID NO: 571] | LGS [SEQ ID NO: 572] | MQALQAPFT [SEQ ID NO: 573] |
| ET200-118 | SSDVGGYNY [SEQ ID NO: 343] | EVS [SEQ ID NO: 575] | SSYTSSSTPYV [SEQ ID NO: 576] |
| ET200-119 | SSNIGSNT [SEQ ID NO: 312] | SNN [SEQ ID NO: 313] | AAWDDSLNGYV [SEQ ID NO: 314] |
| ET200-120 | SSNIGSNT [SEQ ID NO: 312] | SNN [SEQ ID NO: 313] | AAWDDSLNGYV [SEQ ID NO: 314] |
| ET200-121 | RSNIGAGYD [SEQ ID NO: 580] | GNS [SEQ ID NO: 438] | QSYDNTVRESPYV [SEQ ID NO: 581] |
| ET200-122 | SSNIGSNS [SEQ ID NO: 585] | SNN [SEQ ID NO: 313] | AAWDDSLNGYV [SEQ ID NO: 314] |
| ET200-123 | SSNIGSNT [SEQ ID NO: 312] | NND [SEQ ID NO: 586] | AAWDDSLNGYV [SEQ ID NO: 314] |
| ET200-124 | DIGSKS [SEQ ID NO: 588] | DDS [SEQ ID NO: 385] | QVWDSSSDHYV [SEQ ID NO: 375] |
| ET200-125 | SGSIASNY [SEQ ID NO: 318] | EDN [SEQ ID NO: 319] | QSYDSTSVL [SEQ ID NO: 592] |

EXAMPLES

The following examples are put forth so as to provide those of ordinary skill in the art with a complete disclosure and description of how to make and use the antibodies, bispecific antibodies, compositions comprising thereof, screening and therapeutic methods of the presently disclosed subject matter, and are not intended to limit the scope of what the inventors regard as their presently disclosed subject matter. It is understood that various other embodiments may be practiced, given the general description provided above.

Example 1—FcRL5 Expression in Various Tissues

The Expression of human FcRL5 was assessed and evaluated in various tissues. As shown in FIG. 1, human FcRL5 was highly expressed in lymphoma and multiple myeloma, but not in other tissues. Top panel of FIG. 1 shows differential expression of human FcRL5 in tumor cell lines from the Cancer Cell Line Encyclopedia (CCLE). The bottom panel of FIG. 1 shows differential expression of human FcRL5 in normal tissue from BioGPS. As shown in FIG. 1, human FcRL5 expression is limited to MM and lymphoma compared to other malignant cells. Normal expression appeared limited to B-cells and plasma cells.

Figure 2:
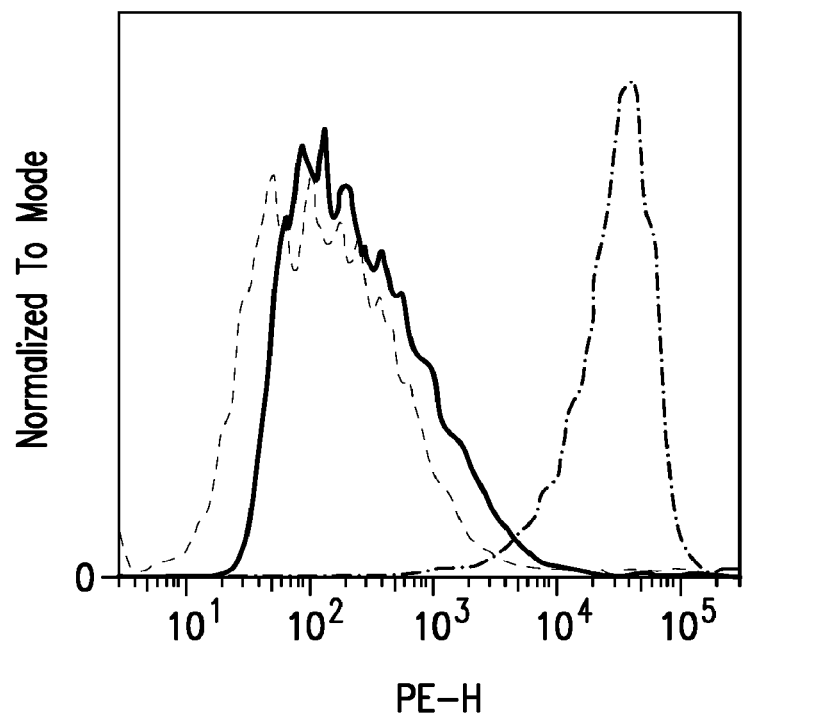
FIG. 2 depicts the screening of anti-FcRL5 scFvs using 3T3 cells expressing FcRL5 or FcRL1, 2, 3, 4 or 6.

Example 2—Selection of scFvs Specific for FcRL5 Using a Fully Human Phage Display Library Phage's display against FcRL5 was performed to enrich for scFv phage clones that bind to FcRL5 specifically. Screening was carried out on FcRL5 overexpressing 3T3 cells or 3T3 cells expressing FcRL1, 2, 3, 4 or 6 as a negative control (FIG. 2). 1080 phage clones were isolated from the enriched panning pools and screened for specific binding to FcRL5 using phage ELISA. Of the 1080 phage clones, 125 clones containing unique scFv sequences were specific to FcRL5 as determined by ELISA. Of the 125 unique clones, 76 clones showed specific binding to FcRL5-overexpressing 3T3 and Raji cells, no cross binding to FcRL1, FcRL2, FcRL3, FcRL4 and FcRL6-overexpressing 3T3 cells and no cross binding to SLAMF9 protein (another FcRL5 subfamily member, no cell line available) (see Tables 1-229 and FIG. 2).

Example 3—Selection of scFvs Specific for Domain 9 of FcRL5

FcRL5 contains 9 extracellular immunoglobulin (Ig)-like domains (domains 1-9) and can be present within a cell in a soluble isoform, a glycosyl-phosphotidyl inositol (GPI)-anchor type isoform and a transmembrane-type isoform (FIG. 3A). As shown in FIG. 3A, the transmembrane-type isoform of FcRL5 includes domain 9; whereas, the soluble isoform and the GPI-anchor type isoform do not.

To test if the scFvs were specific to domain 9 of FcRL5, the 76 clones were further screened on 3T3 cells overexpressing a vector encoding FcRL5 with a domain 9 deletion (FcRL5Δdom9) and further screened on Raji cells overexpressing full-length FcRL5 (FIG. 3B-D). Some clones showed either reduced or diminished binding towards FcRL5-domain 9 deletion-overexpressing 3T3 cells compared to binding towards FcRL5-overexpressing 3T3 cells. FIGS. 4, 5, 6, 7 and 8 shows the specificity of ET200-39, ET200-104, ET200-105, ET200-109 and ET200-117 for domain 9 of FcRL5, respectively.

Example 4—Bispecific Antibodies Specific for FcRL5 and CD3

Figure 9A:
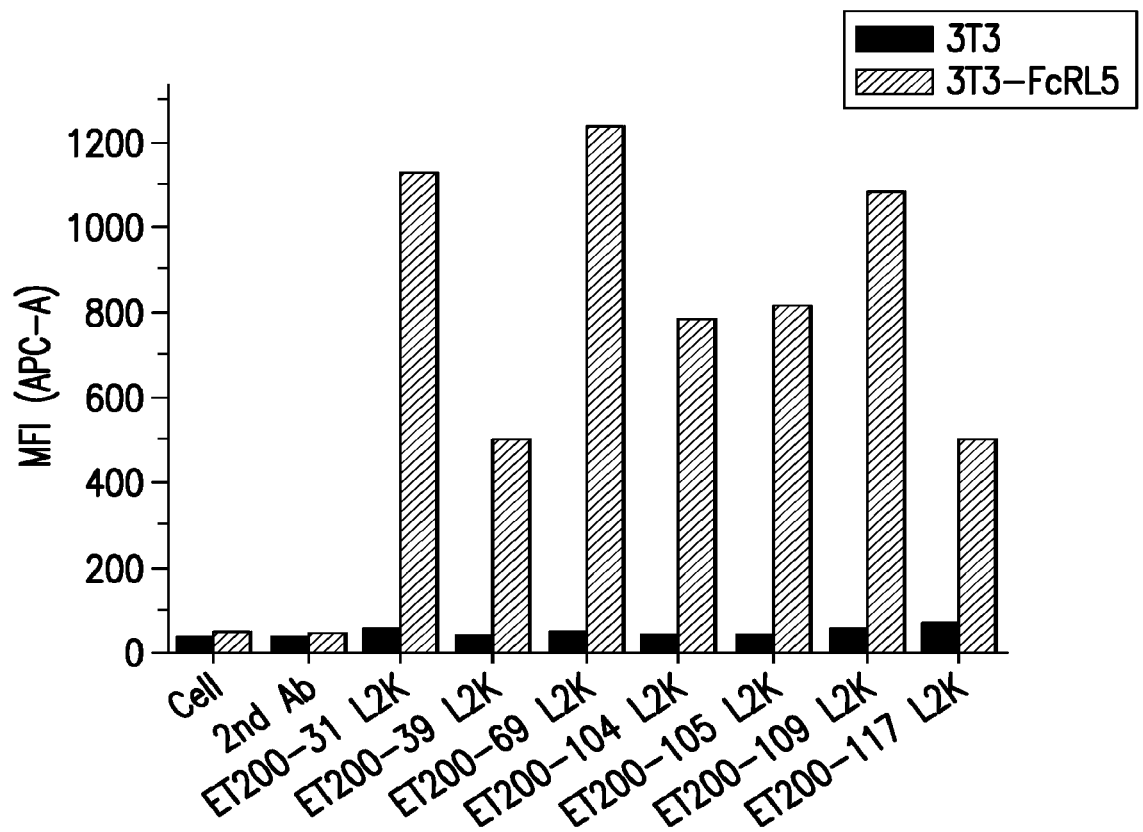

Anti-FcLR5/CD3 bispecific antibodies were generated using the ET200-31, ET200-39, ET200-69, ET200-104, ET200-105, ET200-109 and ET200-117 scFvs disclosed herein. FIGS. 9A and 9B show the FACS analysis of the anti-FcRL5/CD3 bispecific antibodies. Each antibody was incubated with 3T3 or 3T3-FcRL5 cells at 10 µg/ml, followed by the incubation with a FITC-conjugated anti-His tag antibody. The binding to FcRL5 was measured by FACS and expressed as mean fluorescence intensity (MFI). Cells incubated with the secondary antibody alone, the ET901 bispecific antibody control or the cells alone were used as negative controls. As shown in FIGS. 9A and 9B, the anti-FcRL5/CD3 bispecific antibodies generated using the disclosed scFvs specifically bound to 3T3 cells expressing FcRL5.

Example 5—Bispecific Antibodies Specific for FcRL5 and CD3

Two anti-FcRL5 bispecific antibodies, ET200-104 and ET200-117, were analyzed by Pepscan to determine epitope specificity. See Table 231. The target protein is human FcRL5 comprising amino acids 1-851 of SEQ ID NO: 899.

TABLE 231

| Name | Origin | Concentration | Location |
| --- | --- | --- | --- |
| ET200-104 bispecific scFV | human | 2.0 mg/ml | +4° C./22 |
| ET200-117 bispecific scFV | human | 1.6 mg/ml | +4° C./22 |

Methods

The principles of clips technology. CLIPS technology structurally fixes peptides into defined three-dimensional structures. This results in functional mimics of even the most complex binding sites. CLIPS technology is now routinely used to shape peptide libraries into single, double or triple looped structures as well as sheet- and helix-like folds (FIG. 10).

Combinatorial clips library screening in detail. CLIPS library screening starts with the conversion of the target protein into a library of up to 10,000 overlapping peptide constructs, using a combinatorial matrix design. On a solid carrier, a matrix of linear peptides is synthesized, which are subsequently shaped into spatially defined CLIPS constructs (FIG. 11). Constructs representing both parts of the discontinuous epitope in the correct conformation bind the antibody with high affinity, which is detected and quantified. Constructs presenting the incomplete epitope bind the antibody with lower affinity, whereas constructs not containing the epitope do not bind at all. Affinity information is used in iterative screens to define the sequence and conformation of epitopes in detail.

Figure 12:
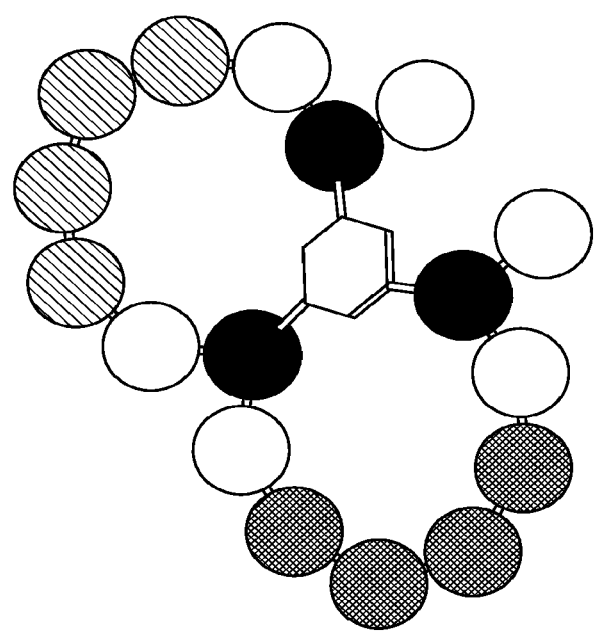
FIG. 12 depicts T3 looped CLIPS™ construct.

Heat map analysis. A heat map is a graphical representation of data where the values taken by a variable in a two-dimensional map are represented as colors. For double-looped CLIPS peptides, such a two-dimensional map can be derived from the independent sequences of the first and second loops. For example, the sequences of the 16 CLIPS peptides depicted in FIG. 13 are effectively permutations of 4 unique sub-sequences in loop 1 (colored in blue in FIG. 12) and 4 unique sub-sequences in loop 2 (colored in green in FIG. 12). Thus, the observed ELISA data (colored in red in FIG. 13A) can be plotted in a 4×4 matrix, where each X coordinate corresponds to the sequence of the first loop, and each Y coordinate corresponds to the sequence of the second loop. For instance, the ELISA value observed for CLIPS peptide CLSSERERVEDLFEYECELLTSEPIFHCRQEDC (indicated with an arrow in FIG. 12A) can be found at the third row, third column of FIG. 13B (indicated with an arrow and a red square). To further facilitate the visualization, ELISA values can be replaced with colors from a continuous gradient. In this case, extremely low values are colored in green, extremely high values are colored in red, and average values are colored in black (see FIG. 13C). For the aforementioned example, the average value is 0.71. When this color map is applied to the data matrix depicted in FIG. 13B, a color heat map is obtained (see FIG. 13D, the original data is still indicated for extra clarity).

Synthesis of peptides. To reconstruct epitopes of the target molecule a library of peptides was synthesized. An amino functionalized polypropylene support was obtained by grafting with a proprietary hydrophilic polymer formulation, followed by reaction with t-butyloxycarbonyl-hexamethylenediamine (BocHMDA) using dicyclohexylcarbodiimide (DCC) with Nhydroxybenzotriazole (HOBt) and subsequent cleavage of the Boc-groups using trifluoroacetic acid (TFA). Standard Fmoc-peptide synthesis was used to synthesize peptides on the amino-functionalized solid support by custom modified JANUS liquid handling stations (Perkin Elmer). Synthesis of structural mimics was done using Pepscan's proprietary Chemically Linked Peptides on Scaffolds (CLIPS) technology. CLIPS technology allows to structure peptides into single loops, doubleloops, triple loops, sheet-like folds, helix-like folds and combinations thereof. CLIPS templates are coupled to cysteine residues. The side-chains of multiple cysteines in the peptides were coupled to one or two CLIPS templates. For example, a 0.5 mM solution of the P2 CLIPS (2,6-bis(bromomethyl)pyridine) was dissolved in ammonium bicarbonate (20 mM, pH 7.8)/acetonitrile (1:3 (v/v)). This solution was added onto the peptide arrays. The CLIPS template bound to side-chains of two cysteines as present in the solid-phase bound peptides of the peptide-arrays (455 wells plate with 3 µl wells). The peptide arrays were gently shaken in the solution for 30 to 60 minutes while completely covered in solution. Finally, the peptide arrays were washed extensively with excess of H$_2$O and sonicated in disrupt-buffer containing 1% SDS/0.1% beta-mercaptoethanol in PBS (pH 7.2) at 70° C. for 30 minutes, followed by sonication in H$_2$O for another 45 minutes. The T3 CLIPS carrying peptides were made in a similar way but now with three cysteines.

ELISA Screening. The binding of antibody to each of the synthesized peptides was tested in a PEPSCAN-based ELISA. The peptide arrays were incubated with primary antibody solution (overnight at 4° C.). After washing, the peptide arrays were incubated with a 1/1000 dilution of an appropriate antibody peroxidase conjugate (SBA) for one hour at 25° C. After washing, the peroxidase substrate 2,2'-azino-di-3-ethylbenzthiazoline sulfonate (ABTS) and 2 µl/ml of 3 percent H$_2$O$_2$ were added. After one hour, the color development was measured. The color development was quantified with a charge coupled device (CCD)—camera and an image processing system.

Data processing. The values obtained from the CCD camera ranged from 0 to 3000 mAU, similar to a standard 96-well plate ELISA-reader. The results were quantified and stored into the Peplab database. Occasionally a well contained an air-bubble resulting in a false-positive value, the cards were manually inspected and any values caused by an air-bubble were scored as 0.

Synthesis quality control. To verify the quality of the synthesized peptides, a separate set of positive and negative control peptides was synthesized in parallel. These were screened with antibody 57.9 (Posthumus et al., J. Virology, 1990, 64:3304-3309).

Results

Screening. Antibody binding depends on a combination of factors, including concentration of the antibody and the amounts and nature of competing proteins in the ELISA buffer. Also, the pre-coat conditions (the specific treatment of the peptide arrays prior to incubation with the experimental sample) affected binding. These details are summed up in Table 232. For the Pepscan Buffer and Preconditioning (SQ), the numbers indicate the relative amount of competing protein (a combination of horse serum and ovalbumin).

TABLE 232

| | Screening conditions | | |
|---|---|---|---|
| Label | Dilution | Sample Buffer | Pre-conditioning |
| ET200-104 | 8 µg/ml | PBS-Tween | PBS-Tween |
| ET200-117 | 3 µg/ml | PBS-Tween | 0.1% SQ |

Antibodies ET200-104 and ET200-117 were coated at 1 µg/ml on a Nunc Maxisorp plate for ELISA and detected with Goat Anti-Human Ig-HRP (Southern Biotech; #2010/05), the same conjugate that is used in minicard screenings. For ET200-104 and ET200-117 signal >1 OD was obtained for some dilutions of the secondary Ab, indicating that the secondary antibody is well suited for detection of these mAbs.

Figures 1, 14:
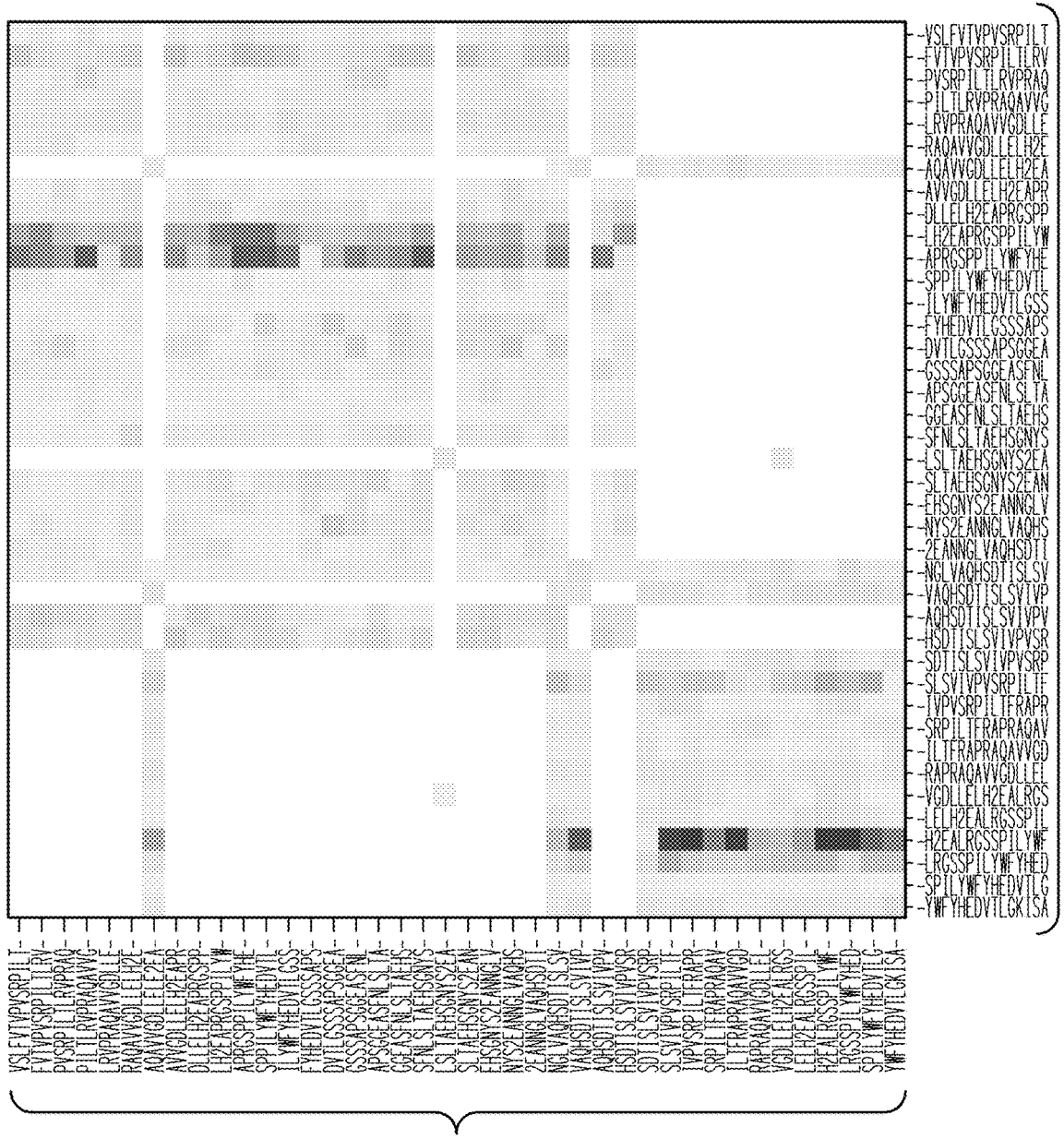
FIG. 14 shows heatmap analysis of data recorded for Herceptin.

Herceptin was used as an internal negative control at high concentration in the absence of blocking buffer. Herceptin bound peptides with common sequences LRGSPLILYRF, LRGSSPILYWF and APRGSPPILYW (FIG. 14). Peptides containing aforementioned sequences were excluded from epitope candidates for test samples.

Figures 1, 15:
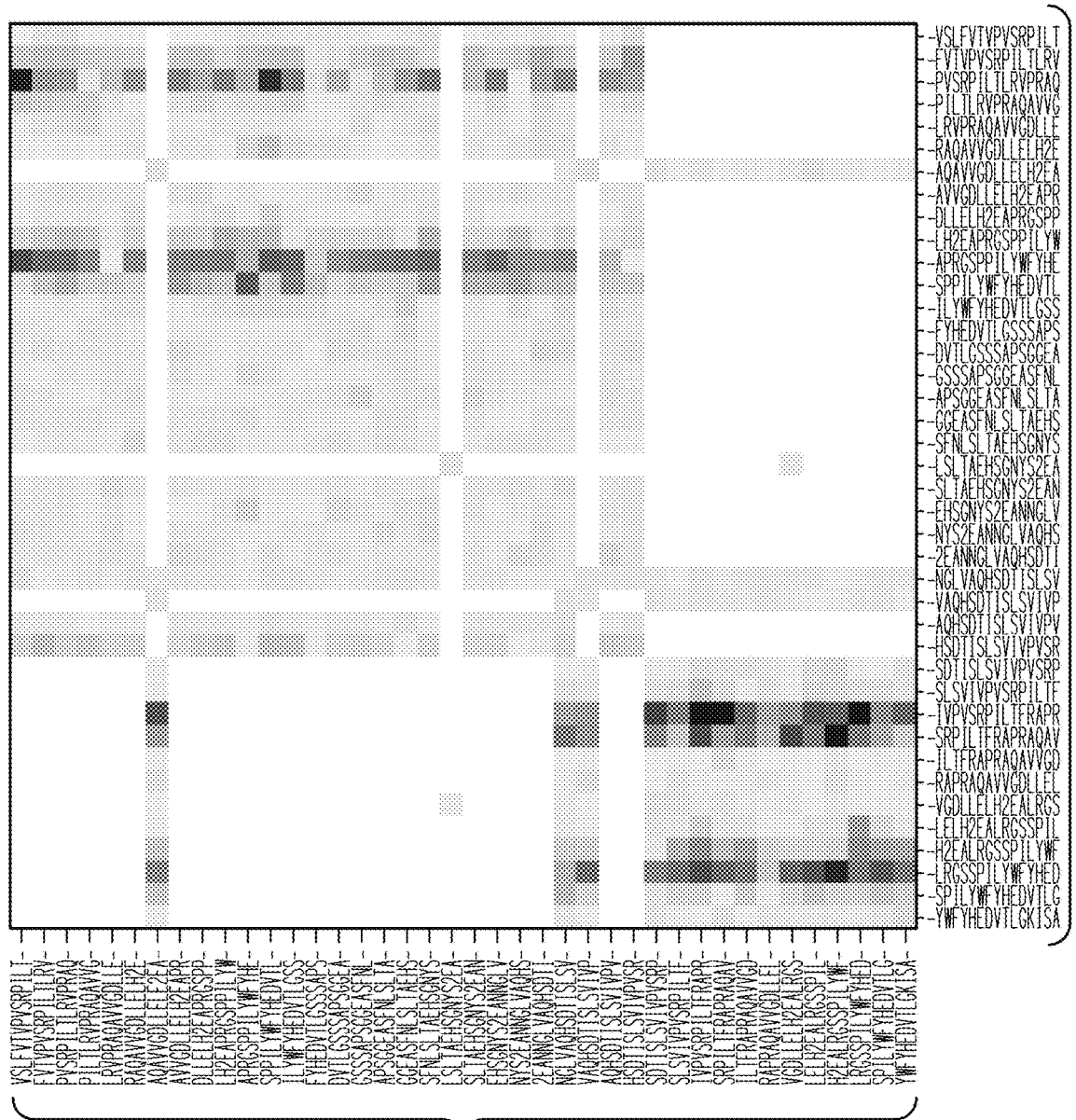
FIG. 15 shows heatmap analysis of data recorded for ET200-104.
Figures 2, 15:
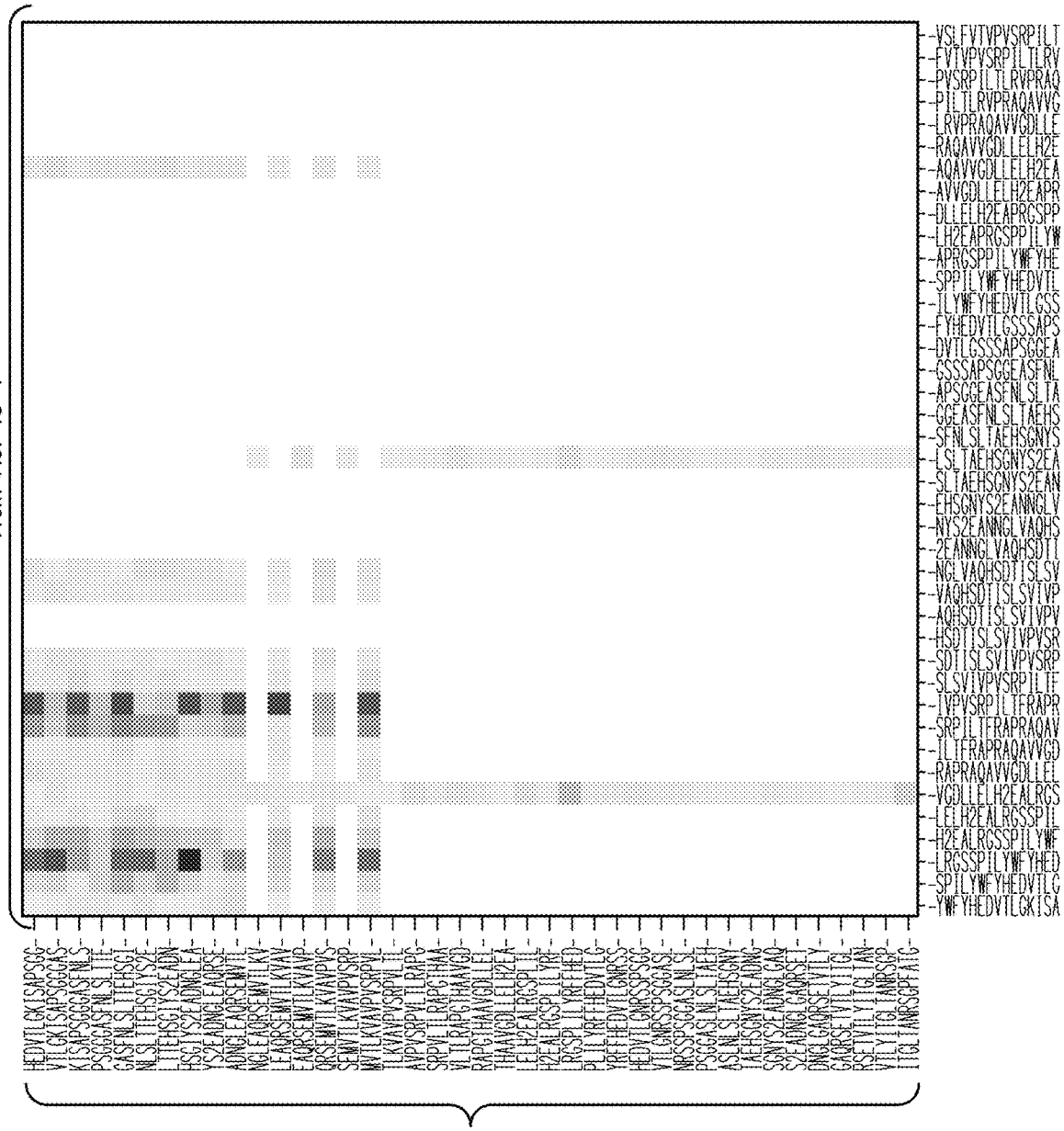
Figures 4, 15:
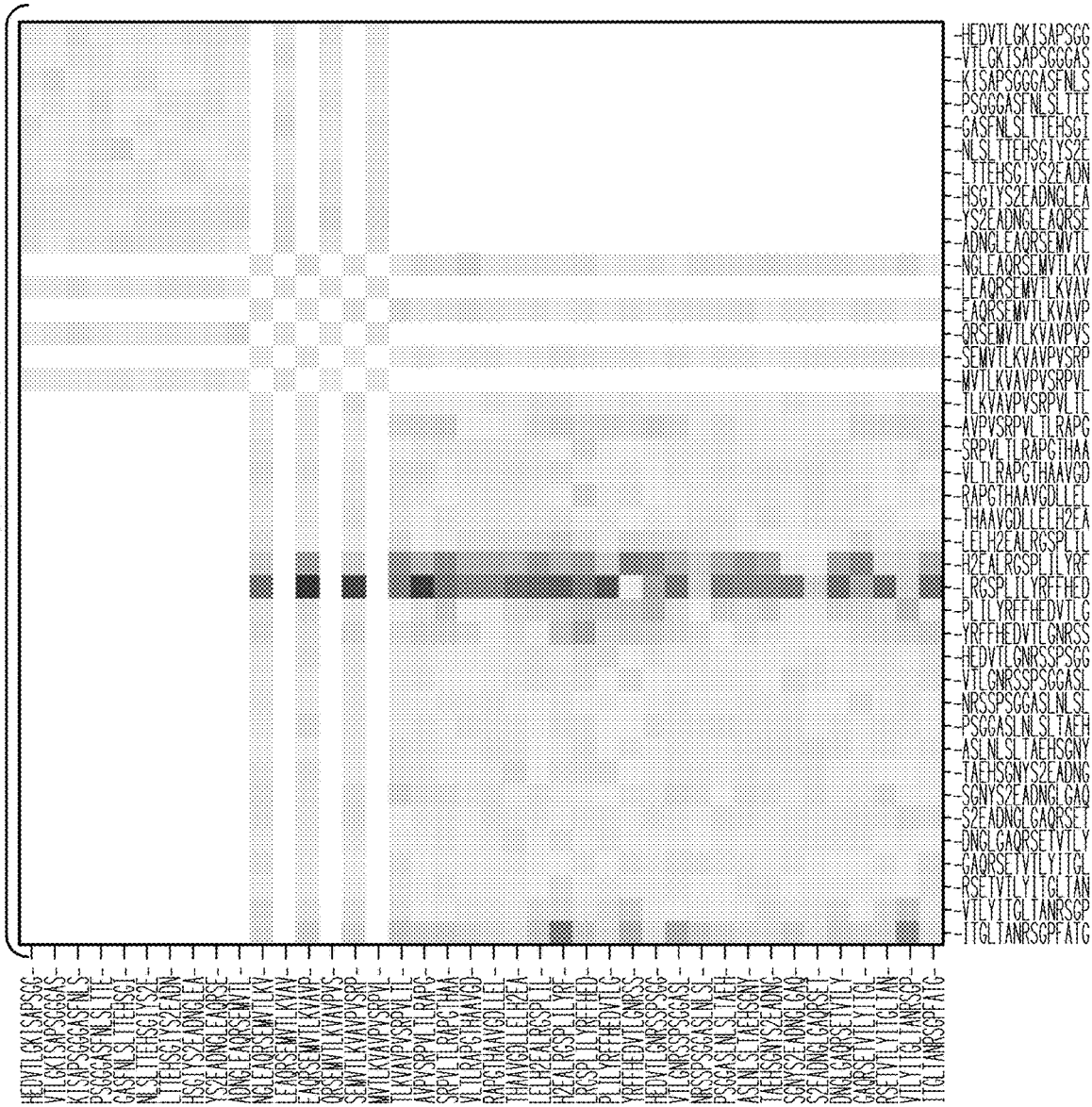
FIG. 4 depicts the screening of anti-FcRL5 scFv ET200-39 on 3T3 cells expressing FcRL5Δdom9.

When tested under low stringency conditions and at a high concentration antibody, ET200-104 binds multiple peptide motifs in all sets (FIG. 15). The majority of peptides bound were suspected to be the result of non-specific hydrophobic interactions based on the results obtained for Herceptin (internal negative control). However, binding of peptides containing motif $_{657}$SRPILTFRAPR$_{667}$ was proposed to be specific, and was uniquely attributed to sample ET200-104.

When tested under low stringency conditions, antibody ET200-117 resulted in weak binding of multiple peptide motifs on all sets. Cumulative data analysis of data obtained for all sets suggests that the antibody uniquely recognizes a region containing peptide stretch $_{829}$RSETVTLYITGL$_{840}$ in domain 9 of Fc receptor-like protein 5 distinct from the Herceptin internal negative control and ET200-104. Again the majority of other peptides bound were suspected to be the result of unspecific hydrophic interactions that shared as the same binding pattern was recorded under low stringency conditions for antibody ET200-104.

CONCLUSIONS

Figure 16:
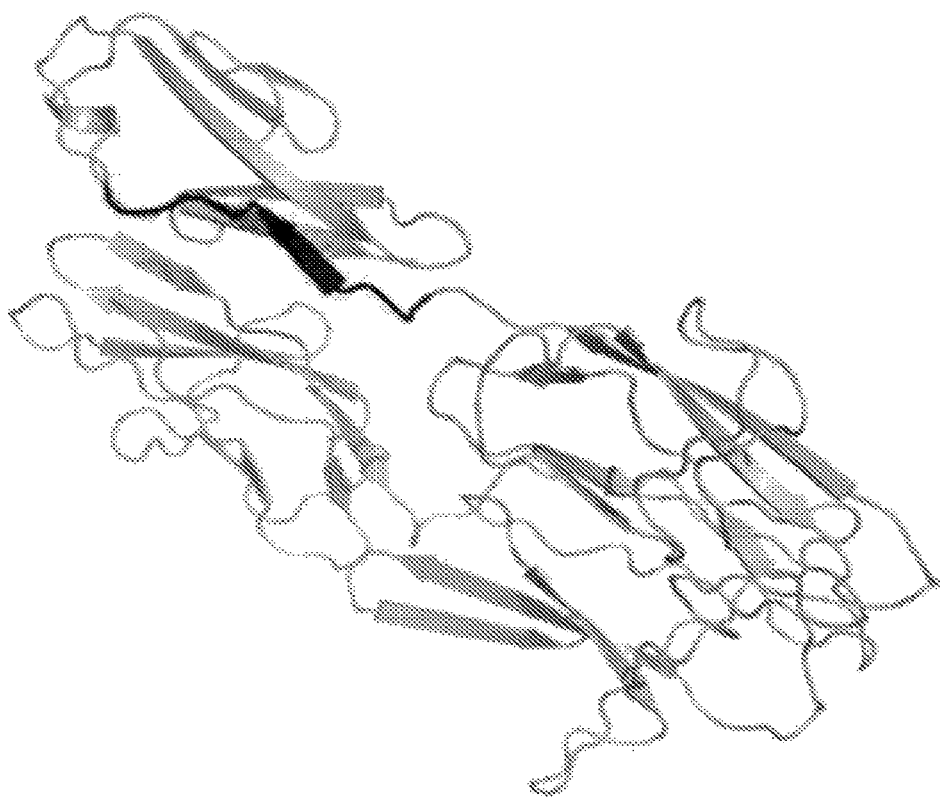
FIG. 16 illustrates a 3D model of amino acid residues 380-731 of FcRL5 with peptide stretch $_{657}$SRPILTFRAPR$_{667}$ highlighted.

Cumulative data analysis of results collected for ET200-104 and ET200-117 vs. Herceptin suggest that antibody ET200-104 targets residues $_{657}$SRPILTFRAPR$_{667}$ within domain 8 of Fc receptor-like protein 5 and antibody ET200-117 targets residues $_{829}$RSETVTLYITGL$_{840}$ within domain 9. Additionally, for both samples multiple signals were recorded with peptides non-specifically bound by Herceptin. The epitope candidate identified for ET200-104 was visualized using a publically available 3D model of Fc receptor-like protein 5 (FIG. 16). The epitope candidate for ET200-117 lies within the non-modeled part of the target and therefore cannot be visualized.

Although the foregoing presently disclosed subject matter has been described in some detail by way of illustration and example for purposes of clarity of understanding, the descriptions and examples should not be construed as limiting the scope of the presently disclosed subject matter. The disclosures of all patent and scientific literature cited herein are expressly incorporated in their entirety by reference.

SEQUENCE LISTING (947 sequences)

SEQ ID NO: 1 - DNA, 333 bp, Artificial Sequence
  Description of Artificial Sequence: Synthetic polynucleotide
cagtctgtgttgacgcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggt

SEQ ID NO: 2 - DNA, 351 bp, Artificial Sequence
  Description of Artificial Sequence: Synthetic polynucleotide
caggtgcagctacagcagtggggcgcaggactgttgaagccttcggagaccctgtccctcacctgcgctgtgtatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcgaaggtccgtacgacggtttcgattcttggggtcaaggtactctggtgaccgtctcctca

SEQ ID NO: 3 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLG

SEQ ID NO: 4 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSS

SEQ ID NO: 5 - DNA, 336 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattctgtggtattcggcggagggaccaagctgaccgtcctaggt

SEQ ID NO: 6 - DNA, 348 bp, Artificial Sequence
  Description of Artificial Sequence: Synthetic polynucleotide
caggtccagctggtacagtctggcactgaggtgaagaagcctggggcctcagtgagggtcgcctgcaaggcttctggttacccctttaacaaatatgacatcaactgggtgcgacaggcccctggacaagggcttgagtggatgggaggcatcatccctatctttcgtacaacaaactacgcacagaagttccagggcagagtcacgattaccgcggacgaatccacgagcacagcctacatggagctgagcagcctgagatctgaggacacggccgtatattactgtgcgcgcgaatggttctactgggatatctggggtcaaggtactctggtgaccgtctcctca

SEQ ID NO: 7 - protein, 112 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLG

SEQ ID NO: 8 - protein, 116 aa, Artificial Sequence
  Description of Artificial Sequence: Synthetic polypeptide
QVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSS

SEQ ID NO: 9 - DNA, 324 bp, Artificial Sequence
  Description of Artificial Sequence: Synthetic polynucleotide
cagtctgtgttgactcagccaccctcagtgtccgtgtccccaggacagacagccagcatctcctgctctggaaataaattggggactaagtatgtttactggtatcagaagaggccaggccagtcccctgtgttggtcatgtatgaagataatcagcggccctcagggatcccggagcggttctctggctccaactctgggaacacagccactctgaccatcagagggacccagactgtggatgaggctgactattactgtcaggcgtgggactccgacactttcgtggtcttcggcggagggaccaaggtcaccgtcctaggt

SEQ ID NO: 10 - DNA, 363 bp, Artificial Sequence
  Description of Artificial Sequence: Synthetic polynucleotide
gaggtgcagctggtggagaccgggggaggcgtggtccagcctgggaggtccctgagactctcctgtgcagcctctggattcaccttcagtagttatggcatgcactgggtccgccaggctccaggcaaggggctggagtgggtggcagttatatcacatgatggaagtaataaatactacgcagactccgtgaagggccgattcaccatctccagagacaattccaaggacacgctgtatctgcaaatgaacagcctgagaggtgaggacacggccgtatattactgtgcgcgctctaaccagtggtctggttacttctctttcgattactggggtcaaggtactctggtgaccgtctcctca

SEQ ID NO: 11 - protein, 108 aa, Artificial Sequence
  Description of Artificial Sequence: Synthetic polypeptide
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLG

SEQ ID NO: 12 - protein, 121 aa, Artificial Sequence
  Description of Artificial Sequence: Synthetic polypeptide
EVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSS

SEQ ID NO: 13 - DNA, 330 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtggtggtcatccattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggt

SEQ ID NO: 14 - DNA, 351 bp, Artificial Sequence
  Description of Artificial Sequence: Synthetic polynucleotide
gaggtgcagctggtgcagtctggagctgaggtgaagaagcctggggcctcagtgaaggtctcctgcaaggcttctggttacacctttaccacctatggtatcagctgggtgcgacaggcccctggacaagggcttgagtggatgggatggatcaacacttacaatggtcacacaaactatgcacagaagctccagggcagagccacaatgaccgcagacacatccacgaacacagcctacatggagctgaggagcctgagatctgacgacactgccgtgtattactgtgcgcgcgttatctacggttctggtgattactggggtcaaggtactctggtgaccgtctcctca

SEQ ID NO: 15 - protein, 110 aa, Artificial Sequence
  Description of Artificial Sequence: Synthetic polypeptide
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLG

SEQ ID NO: 16 - protein, 117 aa, Artificial Sequence
  Description of Artificial Sequence: Synthetic polypeptide
EVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSS

SEQ ID NO: 17 - DNA, 327 bp, Artificial Sequence
  Description of Artificial Sequence: Synthetic polynucleotide
tcctatgtgctgactcagccactctcagtgtcagtggccccaggaaagacggccaggattacctgtgggggaaacaacattggaagtaaaactgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatcgggtgttcggcggagggaccaagctgaccgtcctaggt

SEQ ID NO: 18 - DNA, 348 bp, Artificial Sequence
  Description of Artificial Sequence: Synthetic polynucleotide
caggtgcagctgcaggagtcgggcccaggactggtgaagccttcggagaccctgtccctcacctgcaatgtctctggttactccatcagcagtggttacttttggggctggatccggcagcccccagggaaggggctggagtggattgggagtatctatcatagtaggagcacctactacaacccgtccctcaagagtcgagtcaccatatcagtagacacgtccaagaaccagttctccctgaagctgaactctgtgaccgccgcagacacggccgtgtattactgtgcgcgcggttacggttacttcgattactggggtcaaggtactctggtgaccgtctcctca

SEQ ID NO: 19 - protein, 109 aa, Artificial Sequence
  Description of Artificial Sequence: Synthetic polypeptide
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLG

SEQ ID NO: 20 - protein, 116 aa, Artificial Sequence
  Description of Artificial Sequence: Synthetic polypeptide
QVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSS

SEQ ID NO: 21 - DNA, 336 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttcgaaggtgttcggcggagggaccaagctgaccgtcctaggt

SEQ ID NO: 22 - DNA, 360 bp, Artificial Sequence
  Description of Artificial Sequence: Synthetic polynucleotide
gaggtgcagctggtggagtctgggggaggtgtggtacggcctggggggtccctgagactctcctgtgcagcctctggattcacctttggtgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtatattactgtgcgcgctctaaatacaacttccatgtttactacgattactggggtcaaggtactctggtgaccgtctcctca

SEQ ID NO: 23 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTSKVFGGGTKLTVLG

SEQ ID NO: 24 - protein, 120 aa, Artificial Sequence
  Description of Artificial Sequence: Synthetic polypeptide
EVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSS

SEQ ID NO: 25 - DNA, 333 bp, Artificial Sequence
  Description of Artificial Sequence: Synthetic polynucleotide
cagtctgtgttgacgcagccaccctcagcgtctgggacccccgggcagacagtcaccatctcttgttctggaagcaactccaacatcggaagtaattatgtatactggtaccagcagctcccaggaacggcccccaaactcctcatctataggaataatcagcggccctcaggggtccctgaccgattctcaggctccaagtctggcacctcagcctccctggccatcagtgggctccgctccgaggatgaggctgattattactgtgcagcatgggatgacagcctgagtgcttatgtcttcggaactgggaccaaggtcaccgtcctaggt

SEQ ID NO: 26 - DNA, 360 bp, Artificial Sequence
  Description of Artificial Sequence: Synthetic polynucleotide
caggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctcttctggtaacatggtttcttggaaagatatgtggggtcaaggtactctggtgaccgtctcctca

SEQ ID NO: 27 - protein, 111 aa, Artificial Sequence
  Description of Artificial Sequence: Synthetic polypeptide
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLG

SEQ ID NO: 28 - protein, 120 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSS

SEQ ID NO: 29 - DNA, 336 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactctgtctcctggtaccaacaacacccaggcaaagcccccagactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacccctttagtcttcggaactgggaccaaggtcaccgtcctaggt

SEQ ID NO: 30 - DNA, 348 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgctgttgcttaccatgattggggtcaaggtactctggtgaccgtctcctca

SEQ ID NO: 31 - protein, 112 aa, Artificial Sequence
  Description of Artificial Sequence: Synthetic polypeptide
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLG

SEQ ID NO: 32 - protein, 116 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSS

SEQ ID NO: 33 - DNA, 333 bp, Artificial Sequence
  Description of Artificial Sequence: Synthetic polynucleotide
cagtctgtcgtgacgcagccgccctcagtgtctgcggccccaggacagagggtcaccatctcctgctctggaagcagctccaacatttcgatttatgatgtatcctggtatcagcagctcccaggaacagcccccaaactcctcatttatggcaataataagcgaccctcggggattgctgaccgattctctggctccacgtctggcacgtcagccaccctgggcatcaccggactccagactggggacgaggccgattattactgcggaacatgggatgacagtctgagtgggggggtgttcggcggagggaccaagctgaccgtcctaggt

SEQ ID NO: 34 - DNA, 354 bp, Artificial Sequence
  Description of Artificial Sequence: Synthetic polynucleotide
cagatgcagctggtgcaatctggggctgaggtgaagaagcctgggtcctcggtgaaggtctcctgcgaggcttctggaggcaccctcagcagctatgctatcaactgggtgcgacaggcccctggacaagggcttgagtggatgggagggatcatccctatgtttggtacagcacactacgcacagaagttccagggcagagtcacgattaccgcggacgaatccacgaaaacagcctacatggagctgagcagcctgagatctgaggacactgccgtgtattactgtgcgcgcggtgttcattacgcttctttcgatcattggggtcaaggtactctggtgaccgtctcctca

SEQ ID NO: 35 - protein, 111 aa, Artificial Sequence
  Description of Artificial Sequence: Synthetic polypeptide
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLG

SEQ ID NO: 36 - protein, 118 aa, Artificial Sequence
  Description of Artificial Sequence: Synthetic polypeptide
QMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSS

SEQ ID NO: 37 - DNA, 333 bp, Artificial Sequence
  Description of Artificial Sequence: Synthetic polynucleotide
cagtctgtgttgacgcagccgccctcagtgtctgcggccgcaggacagaaggtcaccatctcctgctctggaagcgactccaacattgggaataattatgtgtcctggtatcaacacctcccagggacagcccccaaactcctcatttatgacgttaaaaatcgaccctcagggattcctgaccggttctccggctccaagtctggctcgtcagccaccctaggcatcgccggactccagcctggggacgaggccgattattactgcggaacatgggacagtcggctggatgcctatgtcttcggaactgggaccaaggtcaccgtcctaggt

SEQ ID NO: 38 - DNA, 351 bp, Artificial Sequence
  Description of Artificial Sequence: Synthetic polynucleotide
cagatgcagctggtgcaatctggagctgaggtgaagaagcctggggcctcagtgaaggtctcctgcaagacttctggtttcccctttaatatctttggaatcacctgggtgcgacaggcccctggacaagggcttgagtggatgggatggatcagcggttacaacggtaacacagactacccacagaagttccagggcagagtcaccatgtccacagacacatccacgagtacagcctacatggagctgaggaacctgaaatctgacgacacggccgtgtattactgtgcgcgcggtgcttacggtggtatggatacttggggtcaaggtactctggtgaccgtctcctca

SEQ ID NO: 39 - protein, 111 aa, Artificial Sequence
  Description of Artificial Sequence: Synthetic polypeptide
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLG

SEQ ID NO: 40 - protein, 117 aa, Artificial Sequence
  Description of Artificial Sequence: Synthetic polypeptide
QMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSS

SEQ ID NO: 41 - DNA, 336 bp, Artificial Sequence
  Description of Artificial Sequence: Synthetic polynucleotide
cagtctgtcgtgacgcagccgccctcagtgtctggggccccagggcagagggtcaccatctcctgcactgggagcacctccaacatcggggcaggttatgatgtacactggtatcagcagcttccaggaacagcccccaaactcctcatctatactaacaactttcggccctcaggggtccctgaccgattctctgcctccaagtctggcacttcagcttccctggccatcactggtctccaggctgaggatgaggctgattattactgcggaacatgggatagcagcctgagtgccgttgtgttcggcggagggaccaagctgaccgtcctaggt

SEQ ID NO: 42 - DNA, 354 bp, Artificial Sequence
  Description of Artificial Sequence: Synthetic polynucleotide
gaggtgcagctggtggagtctggaactgaggtgaagaagcctggggcctcagtgaaagtctcctgcaaggcttctggttacatgtttaccagttatggtctcaactgggtgcgacaggcccctggacaagggcttgagtggatgggatggatcagcgctaacaatggtaagacaaattatgctaagaaattccaggacagagtcaccatgaccagagacacttccacgagcacaggctacatggaactgaggagcctgagatctgacgacacggccgtatattactgtgcgcgccatatcggtggttcttacttcgatcgttggggtcaaggtactctggtgaccgtctcctca

SEQ ID NO: 43 - protein, 112 aa, Artificial Sequence
  Description of Artificial Sequence: Synthetic polypeptide
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLG

SEQ ID NO: 44 - protein, 118 aa, Artificial Sequence
  Description of Artificial Sequence: Synthetic polypeptide
EVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSS

SEQ ID NO: 45 - DNA, 327 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggt

SEQ ID NO: 46 - DNA, 357 bp, Artificial Sequence
  Description of Artificial Sequence: Synthetic polynucleotide
gaggtgcagctggtggagactgggggaggcttggtacagcctggggggtccctgagactctcctgtgcagcctctggattcacctttagcagctatgccatgagctgggtccgccaggctccagggaaggggctggagtgggtctcagctattagtggtagtgatggtagcacatactacgcagactccgtgaagggccggttcaccatctccagagacaattccaagaacacgctgtatctgcaaatgaacagcctgagagacgaggacacggccgtatattactgtgcgcgctctcatgaagctaacctggttggtgattggtggggtcaaggtactctggtgaccgtctcctca

SEQ ID NO: 47 - protein, 109 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLG

SEQ ID NO: 48 - protein, 119 aa, Artificial Sequence
  Description of Artificial Sequence: Synthetic polypeptide
EVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSS

SEQ ID NO: 49 - DNA, 324 bp, Artificial Sequence
  Description of Artificial Sequence: Synthetic polynucleotide
cagtctgtggtgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatgtggtattcggcggagggaccaagctgaccgtcctaggt

SEQ ID NO: 50 - DNA, 354 bp, Artificial Sequence
  Description of Artificial Sequence: Synthetic polynucleotide
gaggtccagctggtacagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgctggggtggtttcggtgctgttgatcattggggtcaaggtactctggtgaccgtctcctca

SEQ ID NO: 51 - protein, 108 aa, Artificial Sequence
  Description of Artificial Sequence: Synthetic polypeptide
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLG

SEQ ID NO: 52 - protein, 118 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSS

SEQ ID NO: 53 - DNA, 327 bp, Artificial Sequence
  Description of Artificial Sequence: Synthetic polynucleotide
tcttctgagctgactcaggaccctgctgtgtctgtggccttgggacagacagtcaagatcacgtgccaaggagacagcctcacagactaccatgcaacctggtaccagcagaagccaggacaggcccctgtcgctgtcatctatgctacaaacaaccggcccactgggatcccagaccgattctctggttccagttccggaaacacagcttctttgaccatcactggggctcaggcggaagatgaggctgactattactgtaattcccgggacagcggcacggacgaagtgttattcggcggagggaccaagctgaccgtcctaggt

SEQ ID NO: 54 - DNA, 345 bp, Artificial Sequence
  Description of Artificial Sequence: Synthetic polynucleotide
gaggtgcagctggtggagactgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcgcgcggtcagggttacgattactggggtcaaggtactctggtgaccgtctcctca

SEQ ID NO: 55 - protein, 109 aa, Artificial Sequence
  Description of Artificial Sequence: Synthetic polypeptide
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLG

SEQ ID NO: 56 - protein, 115 aa, Artificial Sequence
  Description of Artificial Sequence: Synthetic polypeptide
EVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSS

SEQ ID NO: 57 - DNA, 327 bp, Artificial Sequence
  Description of Artificial Sequence: Synthetic polynucleotide
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgagcatcagcagggtcgaagccggggatgaggccgactattactgtcaggtgtgggatagtagtagtgatcatactgtcttcggaactgggaccaaggtcaccgtcctaggt

SEQ ID NO: 58 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgctactacccgggtatggatatgtggggtcaaggtactctggtgaccgtctcctca

SEQ ID NO: 59 - protein, 109 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLG

SEQ ID NO: 60 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSS

SEQ ID NO: 61 - DNA, 333 bp, Artificial Sequence
  Description of Artificial Sequence: Synthetic polynucleotide
caggctgtgctgactcagccgccctcaacgtctgggacccccgggcagagggtcaccatctcttgttctggaagcagctccaacatcgggagaaatggtgtaaactggtaccagcagctcccaggagcggcccccaaagtcctcatctataatgataatcagcgaccctcaggggtccctgaccgagtctctggctcccagtctggctcctcaggcaccctggccatcgatgggcttcggtctgaggatgaggctgattattactgtgcggcatgggatgacagcctgcatggtgtggtattcggcggagggaccaagctgaccgtcctaggt

SEQ ID NO: 62 - DNA, 345 bp, Artificial Sequence
  Description of Artificial Sequence: Synthetic polynucleotide
caggtccagctggtacagtctggggctgaggtgaagaagcctggggcctcagtgaaggtctcctgcaaggtttccggatacaccctcaatgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcggtggttacggtgattcttggggtcaaggtactctggtgaccgtctcctca

SEQ ID NO: 63 - protein, 111 aa, Artificial Sequence
  Description of Artificial Sequence: Synthetic polypeptide
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLG

SEQ ID NO: 64 - protein, 115 aa, Artificial Sequence
  Description of Artificial Sequence: Synthetic polypeptide
QVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSS

SEQ ID NO: 65 - DNA, 336 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattcttgggtgttcggcggagggaccaagctgaccgtcctaggt

SEQ ID NO: 66 - DNA, 396 bp, Artificial Sequence
  Description of Artificial Sequence: Synthetic polynucleotide
caggtgcagctggtgcaatctggggctgaggtgaagaggcctgggtcctcggtgaaggtctcctgcacggcttctggaggcaccttcagcagcgatgctatcagctgggtgcgacaggcccctggacaagggcttgagtggatgggaggaatcatccctatgtttggtacagcaaactacgcacagaagttccagggcagagtcacgattaccgcggacgaatccacgagcacagcctacatggagctgagcagcctgagatctgaggacacggccgtgtattactgtgcgcgcgaaggttactactacccgtctgcttacctgggttctgttctgaacgacatctcttctgtttacgatgaatggggtcaaggtactctggtgaccgtctcctca

SEQ ID NO: 67 - protein, 112 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLG

SEQ ID NO: 68 - protein, 132 aa, Artificial Sequence
  Description of Artificial Sequence: Synthetic polypeptide
QVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSS

SEQ ID NO: 69 - DNA, 336 bp, Artificial Sequence
  Description of Artificial Sequence: Synthetic polynucleotide
cagtctgtcgtgacgcagccgccctcagtgtctgcggccccaggacagaaggtcaccatctcctgctctggaagcacctccaacattggaaataatgatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcgtgagtgcttcttgggtcttcggcagagggaccaagctgaccgtcctaggt

SEQ ID NO: 70 - DNA, 348 bp, Artificial Sequence
  Description of Artificial Sequence: Synthetic polynucleotide
caggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatccacagaagctccagggcagagtcaccatgaccacagacccatccacgagcacagcctacatggagctgaggagcctgagatctgacgacacggccgtgtattactgtgcgcgctctatgacttctttcgattactggggtcaaggtactctggtgaccgtctcctca

SEQ ID NO: 71 - protein, 112 aa, Artificial Sequence
  Description of Artificial Sequence: Synthetic polypeptide
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLG

SEQ ID NO: 72 - protein, 116 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSS

SEQ ID NO: 73 - DNA, 336 bp, Artificial Sequence
  Description of Artificial Sequence: Synthetic polynucleotide
cagtctgtgttgacgcagccgccctcagtgtctgcggccccaggacagaaggtcaccatctcctgctctggaagcaactccaacattgggaataattatgtatcctggtatcagcaactcccagggacagcccccaaactcctcatttatgacaataataagcgaccctcagggattcctgaccgattctctggctccaggtctggcacgtcagccaccctgggcatcaccggactccagactggggacgaggccgattattactgcggaacatggaataccactgtgactcctggctatgtcttcggaactgggaccaaggtcaccgtcctaggt

SEQ ID NO: 74 - DNA, 348 bp, Artificial Sequence
  Description of Artificial Sequence: Synthetic polynucleotide
gaagtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacaccgccatgtattactgtgcgcgctctgtttacgacctggatacttggggtcaaggtactctggtgaccgtctcctca

SEQ ID NO: 75 - protein, 112 aa, Artificial Sequence
  Description of Artificial Sequence: Synthetic polypeptide
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLG

SEQ ID NO: 76 - protein, 116 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSS

SEQ ID NO: 77 - DNA, 336 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgggggccccttatgtcttcggaactgggaccaaggtcaccgtcctaggt

SEQ ID NO: 78 - DNA, 357 bp, Artificial Sequence
  Description of Artificial Sequence: Synthetic polynucleotide
gaggtgcagctggtgcagtcttggggaggctcggaacagcctggcaggtccctgagactctcctgtgcagcctctggattcacctttgatgattatgccatgcactgggtccggcaagctccagggaagggcctggagtgggtctcaggtattagttggaatagcggtagcataggctatgcggactctgtgaagggccgattcaccatctccagagacaacgccaagaattccctgtatctgcaaatgaacagtctgagagctgaggacaccgccatgtattactgtgcgcgctaccgtcaggttggttctgcttacgattcttggggtcaaggtactctggtgaccgtctcctca

SEQ ID NO: 79 - protein, 112 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLG

SEQ ID NO: 80 - protein, 119 aa, Artificial Sequence
  Description of Artificial Sequence: Synthetic polypeptide
EVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSS

SEQ ID NO: 81 - DNA, 330 bp, Artificial Sequence
  Description of Artificial Sequence: Synthetic polynucleotide
ctgcctgtgctgactcagccaccctcggtgtcagtggccccaggaaagacggccaggattacctgtgggggaaacaacattggaagtaaaagtgtgcactggtatcagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggatagtagtagttatcataattatgtcttcggaactgggaccaaggtcaccgtcctaggt

SEQ ID NO: 82 - DNA, 354 bp, Artificial Sequence
  Description of Artificial Sequence: Synthetic polynucleotide
gaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacaccgccatgtattactgtgcgcgctactggggtttcggtgtttctgatcgttggggtcaaggtactctggtgaccgtctcctca

SEQ ID NO: 83 - protein, 110 aa, Artificial Sequence
  Description of Artificial Sequence: Synthetic polypeptide
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLG

SEQ ID NO: 84 - protein, 118 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSS

SEQ ID NO: 85 - DNA, 336 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccccgatcggttctctggctccatcgacagctcctccaactctgcctccctcaccatctctggactgaagactgaggacgaggctgactactactgtcagtcttatgacagcagcaatctttgggtgttcggcggagggaccaagctgaccgtcctaggt

SEQ ID NO: 86 - DNA, 351 bp, Artificial Sequence
  Description of Artificial Sequence: Synthetic polynucleotide
cagatgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactactactacgattcttggggtcaaggtactctggtgaccgtctcctca

SEQ ID NO: 87 - protein, 112 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLG

SEQ ID NO: 88 - protein, 117 aa, Artificial Sequence
  Description of Artificial Sequence: Synthetic polypeptide
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSS

SEQ ID NO: 89 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaacgt

SEQ ID NO: 90 - DNA, 354 bp, Artificial Sequence
  Description of Artificial Sequence: Synthetic polynucleotide
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacaccgccatgtattactgtgcgcgctactggggttacgactcttacgatgaatggggtcaaggtactctggtgaccgtctcctca

SEQ ID NO: 91 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKR

SEQ ID NO: 92 - protein, 118 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSS

SEQ ID NO: 93 - DNA, 333 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggt

SEQ ID NO: 94 - DNA, 351 bp, Artificial Sequence
  Description of Artificial Sequence: Synthetic polynucleotide
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcaacaaccattactacaacgattactggggtcaaggtactctggtgaccgtctcctca

SEQ ID NO: 95 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLG

SEQ ID NO: 96 - protein, 117 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSS

SEQ ID NO: 97 - DNA, 336 bp, Artificial Sequence
  Description of Artificial Sequence: Synthetic polynucleotide
cagtctgtgttgacgcagccgccctcagtgtctggggccccagggcagggggtcaccatcccctgcactgggagcagctccaacatcggggcaggttatgatgtacactggtaccagcagcttccagggacagcccccaaactcctcatctatggtaacaacaatcggccctcaggggtccctgaccgcttctctggctccaggtctggctcctcagcctccctggccatcactgggctccaggctgaggatgaggctgattattactgccagtcctatgacagcagcctgagtgatgtggtattcggcggagggaccaaggtcaccgtcctaggt

SEQ ID NO: 98 - DNA, 378 bp, Artificial Sequence
  Description of Artificial Sequence: Synthetic polynucleotide
gaggtccagctggtgcagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcgcgctactggtcttactctttcgactacctgtacatgccggaaggtaacgattggtggggtcaaggtactctggtgaccgtctcctca

SEQ ID NO: 99 - protein, 112 aa, Artificial Sequence
  Description of Artificial Sequence: Synthetic polypeptide
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLG

SEQ ID NO: 100 - protein, 126 aa, Artificial Sequence
  Description of Artificial Sequence: Synthetic polypeptide
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSS

SEQ ID NO: 101 - DNA, 333 bp, Artificial Sequence
  Description of Artificial Sequence: Synthetic polynucleotide
cagtctgtgttgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggt

SEQ ID NO: 102 - DNA, 357 bp, Artificial Sequence
  Description of Artificial Sequence: Synthetic polynucleotide
caggtccagctggtacagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgcgacctgtactactacgaaggtgttgattactggggtcaaggtactctggtgaccgtctcctca

SEQ ID NO: 103 - protein, 111 aa, Artificial Sequence
  Description of Artificial Sequence: Synthetic polypeptide
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLG

SEQ ID NO: 104 - protein, 119 aa, Artificial Sequence
  Description of Artificial Sequence: Synthetic polypeptide
QVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSS

SEQ ID NO: 105 - DNA, 327 bp, Artificial Sequence
  Description of Artificial Sequence: Synthetic polynucleotide
caggctgtgctgactcagccaccctcagtgtcagtggccccaggaaagacggccagggttacctgtgggggaaacaacattggaagtgaaagtgtgcactggtaccagcagaagccaggccaggcccctgtgttggtcatctattatgataccgaccggccctcagggatccctgagcgattctctggctcccactctgggaccacggccaccctgaccatcagcagggtcgaagccggggatgaggccgactattactgtcaggtgtgggatagtagtagggatcatgtggtattcggcggagggaccaagctgaccgtcctaggt

SEQ ID NO: 106 - DNA, 357 bp, Artificial Sequence
  Description of Artificial Sequence: Synthetic polynucleotide
caggtgcagctggtgcagtctgggggaggcgtggtccagcctgggaggtccctgagactctcctgtgcggcctctggattcaccttcagtagctatgctatgcactgggtccgccaggctccaggcaagggactggagtgggtggcagttatatcatatgatggaagcaataaatactacgcagactccgtgaagggcctattcaccatctccagagacaattccaagaacacgctgtatctgcaaatgaacagcctgagagctgaggacacggccgtgtattactgtgcgcgctcttacttcacttctggtttctacgattactggggtcaaggtactctggtgaccgtctcctca

SEQ ID NO: 107 - protein, 109 aa, Artificial Sequence
  Description of Artificial Sequence: Synthetic polypeptide
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLG

SEQ ID NO: 108 - protein, 119 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSS

SEQ ID NO: 109 - DNA, 339 bp, Artificial Sequence
  Description of Artificial Sequence: Synthetic polynucleotide
cagtctgtcgtgacgcagccgccctcagtgtctggggccccagggcagagggtcaccatctcctgcactgggagcagttccaacatcggggcaggttatgatgtaaattggtatcagcagtttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggt

SEQ ID NO: 110 - DNA, 348 bp, Artificial Sequence
  Description of Artificial Sequence: Synthetic polynucleotide
cagatgcagctggtgcagtctggggctgaggtgaagaagcctggggcctcagtgaaggtctcctgcaaggcttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcatgtcttctatgtactacgattggggtcaaggtactctggtgaccgtctcctca

SEQ ID NO: 111 - protein, 113 aa, Artificial Sequence
  Description of Artificial Sequence: Synthetic polypeptide
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLG

SEQ ID NO: 112 - protein, 116 aa, Artificial Sequence
  Description of Artificial Sequence: Synthetic polypeptide
QMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSS

SEQ ID NO: 113 - DNA, 324 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgattatgtcttcggaactgggaccaaggtcaccgtcctaggt

SEQ ID NO: 114 - DNA, 345 bp, Artificial Sequence
  Description of Artificial Sequence: Synthetic polynucleotide
gaggtgcagctggtggagactgggggaggcttggtcaagcctggagggtccctgagactctcctgtgcagcctctggattcaccgtcagtgactactacatgagctggatccgccaggctccagggaagggcctggagtggatttcatacattagtggtagtggtaatagcatatactacgcagactctgtgaagggccgattcaccatctccagggacaacgccaagaactcactggatctgcaaatgaccagcctgagagccgaggacacggccgtatattactgtgcgcgctctactaaattcgattactggggtcaaggtactctggtgaccgtctcctca

SEQ ID NO: 115 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLG

SEQ ID NO: 116 - protein, 115 aa, Artificial Sequence
  Description of Artificial Sequence: Synthetic polypeptide
EVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSS

SEQ ID NO: 117 - DNA, 333 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacgtcggaagttacactgtaaactggtaccggcaactcccaggaacggcccccacactcctcatctataataataatcagcggccctcaggggtccctgaccgattctctgactccaagtctggcacctcggcctccctgaccattagtgggctccagcctgaggatgaggctgattattattgtgcagcatgggatgacaggctgggtggttatgtcttcggaactgggaccaaggtcaccgtcctaggt

SEQ ID NO: 118 - DNA, 357 bp, Artificial Sequence
  Description of Artificial Sequence: Synthetic polynucleotide
gaggtgcagctggtgcagtctggagcagaggtgaaaaagccgggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctacagtggagcagcctgaaggcctcggacaccgccatgtattactgtgcgcgctctactggttcttctcatatgtctgatgaatggggtcaaggtactctggtgaccgtctcctca

SEQ ID NO: 119 - protein, 111 aa, Artificial Sequence
  Description of Artificial Sequence: Synthetic polypeptide
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLG

SEQ ID NO: 120 - protein, 119 aa, Artificial Sequence
  Description of Artificial Sequence: Synthetic polypeptide
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSS

SEQ ID NO: 121 - DNA, 336 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcattgggtgttcggcggagggaccaagctgaccgtcctaggt

SEQ ID NO: 122 - DNA, 345 bp, Artificial Sequence
  Description of Artificial Sequence: Synthetic polynucleotide
caagtgcagctacagcagtggggcgcaggactgttgaagccttcggagaccctgtccctcacctgcgctgtctatggtgggtccttcagtggttactactggagctggatccgccagcccccagggaaggggctggagtggattggggagatcactcatagtggaaggtccaactacaacccgtccctcaagagtcgagtcaccatatcagtagacacgtccaagaaccagttctccctgaagctgagctctgtgaccgccgcggacacggccgtgtattactgtgcgcgctcttctatcatgtctgattactggggtcaaggtactctggtgaccgtctcctca

SEQ ID NO: 123 - protein, 112 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLG

SEQ ID NO: 124 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSS

SEQ ID NO: 125 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcacctccaacatcggggcaggttatgatgtacactggtaccagcagcttccaggaacagcccccaaactcctcatcaacaataacaggaatcggccctcaggggtccctgaccgattctctggctccaagtctggcacgtcagccaccctgggcatcaccggactccagactggggacgaggccgattattactgcggaacatgggatggcagcctgactggtgcagtgttcggcggagggaccaagctgaccgtcctaggt

SEQ ID NO: 126 - DNA, 354 bp, Artificial Sequence
  Description of Artificial Sequence: Synthetic polynucleotide
gaggtccagctggtgcagtctggggctgaggtgaagaagcctgggtcctcggtgaaggtctcatgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcggttctgctctggaccattacgatcgttggggtcaaggtactctggtgaccgtctcctca

SEQ ID NO: 127 - protein, 112 aa, Artificial Sequence
  Description of Artificial Sequence: Synthetic polypeptide
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLG

SEQ ID NO: 128 - protein, 118 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSS

SEQ ID NO: 129 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccaattgggtgttcggcggagggaccaagctgaccgtcctaggt

SEQ ID NO: 130 - DNA, 351 bp, Artificial Sequence
  Description of Artificial Sequence: Synthetic polynucleotide
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactacttcaacgattactggggtcaaggtactctggtgaccgtctcctca

SEQ ID NO: 131 - protein, 111 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLG

SEQ ID NO: 132 - protein, 117 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSS

SEQ ID NO: 133 - DNA, 330 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggt

SEQ ID NO: 134 - DNA, 351 bp, Artificial Sequence
  Description of Artificial Sequence: Synthetic polynucleotide
cagatgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctctatgttcggtgctcatgattcttggggtcaaggtactctggtgaccgtctcctca

SEQ ID NO: 135 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLG

SEQ ID NO: 136 - protein, 117 aa, Artificial Sequence
  Description of Artificial Sequence: Synthetic polypeptide
QMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSS

SEQ ID NO: 137 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttttgatgtacactggtaccagctacttccaggaacagcccccaaactcctcatctatgctaacagcaatcggccctcaggggtccctgaccgattctctggctccaagtctggcacctcagcctccctggccatcactgggctcctggctgaggatgaggctgattattactgccagtcctatgacagcagcctgagtggtgtggtattcggcggagggaccaagctgaccgtcctaggt

SEQ ID NO: 138 - DNA, 354 bp, Artificial Sequence
  Description of Artificial Sequence: Synthetic polynucleotide
caggtgcagctggtgcaatctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgcggtgcttctttcgaccgtcatgataactggggtcaaggtactctggtgaccgtctcctca

SEQ ID NO: 139 - protein, 112 aa, Artificial Sequence
  Description of Artificial Sequence: Synthetic polypeptide
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLG

SEQ ID NO: 140 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSS

SEQ ID NO: 141 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggt

SEQ ID NO: 142 - DNA, 351 bp, Artificial Sequence
  Description of Artificial Sequence: Synthetic polynucleotide
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgctctaactactactacaacgattactggggtcaaggtactctggtgaccgtctcctca

SEQ ID NO: 143 - protein, 111 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLG

SEQ ID NO: 144 - protein, 117 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSS

SEQ ID NO: 145 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggt

SEQ ID NO: 146 - DNA, 348 bp, Artificial Sequence
  Description of Artificial Sequence: Synthetic polynucleotide
caggtgcagctggtgcagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgctactctggtgtttactacgattggggtcaaggtactctggtgaccgtctcctca

SEQ ID NO: 147 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLG

SEQ ID NO: 148 - protein, 116 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSS

SEQ ID NO: 149 - DNA, 336 bp, Artificial Sequence
  Description of Artificial Sequence: Synthetic polynucleotide
aattttatgctgactcagccccactctgtgtcggggtctccggggaagacggtaaccatctcctgcaccggcagcagtggcagcattgccgacaactttgtgcagtggtaccagcagcgcccgggcggtgtccccaccactgtgatctttaatgatgacgaaagaccctctggcgtccctgatcggttctctggctccatcgacacctcctccaattctgcctccctcaccatctctggactgaagactgaggacgaggctgactactactgtcagtcttatgataataataatcgaggggtgttcggcggagggaccaagctgaccgtcctaggt

SEQ ID NO: 150 - DNA, 348 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaaccctaacagtggtaacacaggctatgcacagaagttccagggcagagtcaccatgaccaggaacacctccataagcacagcctacatggagctgagcaacctgagatctgaggacacggccgtgtattactgtgcgcgctactactcttacggttacgattggggtcaaggtactctggtgaccgtctcctca

SEQ ID NO: 151 - protein, 112 aa, Artificial Sequence
  Description of Artificial Sequence: Synthetic polypeptide
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLG

SEQ ID NO: 152 - protein, 116 aa, Artificial Sequence
  Description of Artificial Sequence: Synthetic polypeptide
QVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSS

SEQ ID NO: 153 - DNA, 336 bp, Artificial Sequence
  Description of Artificial Sequence: Synthetic polynucleotide
cagtctgtcgtgacgcagccgccctcagtgtctggggccccagggcagacggtcaccatctcctgcactgggggcagctccaacatcgggacaggttattttgtaaattggtaccagcaggttccaggaaaagcccccaaactcctcatcctgggtaacaataatcggccctcgggggtccctgaccgactctccggctccacgtccggcacctcagcctccctggccatcactgggctccaggctgaggatgagggtacttattactgccagtcctatgacagcagcctgagtggttatgtcttcggaactgggaccaaggtcaccgtcctaggt

SEQ ID NO: 154 - DNA, 366 bp, Artificial Sequence
  Description of Artificial Sequence: Synthetic polynucleotide
caggtacagctgcagcagtcaggtccaggactggtgaagccctcgcagaccctctcactcacctgtggcatctccggggacagtgtctctaccaacagtgttgcttggcactggatcaggcagtccccatcgagaggccttgagtggctgggaaggacatactacaggtccaagtggtctaatgactatggagtatctgtgaaaagtcgaatcaccatcatcccagacacatccaagaaccagttctccctgcagctgaactctgtgactcccgaggacacggctgtgtattactgtgcgcgctcttcttcttggtaccagatcttcgattactggggtcaaggtactctggtgaccgtctcctca

SEQ ID NO: 155 - protein, 112 aa, Artificial Sequence
  Description of Artificial Sequence: Synthetic polypeptide
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLG

SEQ ID NO: 156 - protein, 122 aa, Artificial Sequence
  Description of Artificial Sequence: Synthetic polypeptide
QVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSS

SEQ ID NO: 157 - DNA, 336 bp, Artificial Sequence
  Description of Artificial Sequence: Synthetic polynucleotide
aattttatgctgactcagccccactctgtgtcggagtctccggggaagacggtaaccatctcctgcaccggcagcagcgacagcatagccaacaactatgttcagtggtaccagcagcgcccgggcagtgcccccaccaatgtgatctacgaagatgtccaaagaccctctggggtccctgatcggttctctgggtccatcgacagctcctccaactctgcctccctcaccatctctggactgaagactgaggacgaggctgtctactattgtcagtcttatcatagcgacaatcgttgggtgttcggcggcgggaccaagctgaccgtcctaggt

SEQ ID NO: 158 - DNA, 363 bp, Artificial Sequence
  Description of Artificial Sequence: Synthetic polynucleotide
caggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgcgctctggtgcttactgggactactctgtttacgatgaatggggtcaaggtactctggtgaccgtctcctca

SEQ ID NO: 159 - protein, 112 aa, Artificial Sequence
  Description of Artificial Sequence: Synthetic polypeptide
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLG

SEQ ID NO: 160 - protein, 121 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSS

SEQ ID NO: 161 - DNA, 324 bp, Artificial Sequence
  Description of Artificial Sequence: Synthetic polynucleotide
cagtctgtgttgactcagccaccctcagtgtccgtgtccccaggacagacagccaccatcgcctgttctggacataaattgggggataaatatgcttcctggtatcagcagaagtcgggccagtcccctgtgttgatcatctatcaggataataagcggccctcagggattcctgagcgattctctggctccaactctgggaacacagccactctgaccatcagcgggacccaggctctggatgaggctgactattattgtcaggcgtgggacagtagtacttatgtggcattcggcggagggaccaagctgaccgtcctaggt

SEQ ID NO: 162 - DNA, 357 bp, Artificial Sequence
  Description of Artificial Sequence: Synthetic polynucleotide
caggtgcagctgcaggagtccggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccatccctcaagagtcgagtcaccatatcagtagacaagtccaagaaccagttctccctgaagctgagctctgtgaccgccgcggacacggccgtgtattactgtgcgcgcatgactactcatactttcggttacgatgcttggggtcaaggtactctggtgaccgtctcctca

SEQ ID NO: 163 - protein, 108 aa, Artificial Sequence
  Description of Artificial Sequence: Synthetic polypeptide
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLG

SEQ ID NO: 164 - protein, 119 aa, Artificial Sequence
  Description of Artificial Sequence: Synthetic polypeptide
QVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSS

SEQ ID NO: 165 - DNA, 327 bp, Artificial Sequence
  Description of Artificial Sequence: Synthetic polynucleotide
cagcctgtgctgactcagccaccctcagtgtcagtggccccaggaaagacggccacgattacttgtgggggaaacaacattggaagtgaaagtgtgcactggtaccaccagaagccaggccaggcccctgtgttggtcatctatgatgatgccggccggccctcagggatccctgagcgattcactggctccaactctgggaacacggccaccctgaccatcagcagggtcgaagccggggatgaggccgactattactgtcaggtgtgggacagaaatagtgctcagtttgtcttcggacctgggaccaaggtcaccgtcctaggt

SEQ ID NO: 166 - DNA, 345 bp, Artificial Sequence
  Description of Artificial Sequence: Synthetic polynucleotide
gaggtccagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgttcatctggattggtggggtcaaggtactctggtgaccgtctcctca

SEQ ID NO: 167 - protein, 109 aa, Artificial Sequence
  Description of Artificial Sequence: Synthetic polypeptide
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLG

SEQ ID NO: 168 - protein, 115 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSS

SEQ ID NO: 169 - DNA, 333 bp, Artificial Sequence
  Description of Artificial Sequence: Synthetic polynucleotide
cagtctgtcgtgacgcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggttatgtcttcggaactgggaccaagctgaccgtcctaggt

SEQ ID NO: 170 - DNA, 375 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcctgtacgaaggtggttaccatggttggggttcttggctgtcttctgattcttggggtcaaggtactctggtgaccgtctcctca

SEQ ID NO: 171 - protein, 111 aa, Artificial Sequence
  Description of Artificial Sequence: Synthetic polypeptide
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLG

SEQ ID NO: 172 - protein, 125 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSS

SEQ ID NO: 173 - DNA, 336 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttattgggtgttcggcggagggaccaagctgaccgtcctaggt

SEQ ID NO: 174 - DNA, 351 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgcgcgaaggggcatttgatgcttttgatatctggggccaagggacaatggtcaccgtctcttca

SEQ ID NO: 175 - protein, 112 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLG

SEQ ID NO: 176 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVS

SEQ ID NO: 177 - DNA, 333 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaattatgtatactggtaccagcagctcccaggaacggcccccaaactcttcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttatctcttcggaactgggaccaaggtcaccgtcctaggt

SEQ ID NO: 178 - DNA, 360 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaatggcgactccaactactactacggtatggacgtctggggccaagggaccacggtcaccgtctcctca

SEQ ID NO: 179 - protein, 111 aa, Artificial Sequence
  Description of Artificial Sequence: Synthetic polypeptide
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLG

SEQ ID NO: 180 - protein, 120 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSS

SEQ ID NO: 181 - DNA, 336 bp, Artificial Sequence
  Description of Artificial Sequence: Synthetic polynucleotide
cagtctgccctgactcagcctgcctccgtgtccgggtctcctggacagtcgatcaccatctcctgcactggaaccagcagtgacattggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcatctcatatacacgcacctggaacccctatgtcttcgggagtgggaccaaggtcaccgtcctaggt

SEQ ID NO: 182 - DNA, 369 bp, Artificial Sequence
  Description of Artificial Sequence: Synthetic polynucleotide
gaggtgcagctggtgcagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatcgggcagcagctggctactactactacggtatggacgtctggggccaagggaccacggtcaccgtctcctca

SEQ ID NO: 183 - protein, 112 aa, Artificial Sequence
  Description of Artificial Sequence: Synthetic polypeptide
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLG

SEQ ID NO: 184 - protein, 123 aa, Artificial Sequence
  Description of Artificial Sequence: Synthetic polypeptide
EVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSS

SEQ ID NO: 185 - DNA, 318 bp, Artificial Sequence
  Description of Artificial Sequence: Synthetic polynucleotide
ctgcctgtgctgactcagccaccctcagtgtccgtgtccccaggacagacagccatcatcacctgctctggagataaattgggggaaaaatatgtttcctggtatcagcagaagccaggccagtcccctgtactggtcatcgatcaagataccaggaggccctcagggatccctgagcgattctctggctccaactctgggaccacagccactctgaccatcagcgggacccaggctatggatgaggctgactattactgtcaggcgtgggacaggggtgtggtattcggcggagggaccaagctgaccgtcctaggt

SEQ ID NO: 186 - DNA, 369 bp, Artificial Sequence
  Description of Artificial Sequence: Synthetic polynucleotide
gaggtgcagctggtggagtctgggggagacttggtacagcctggcaggtccctgagactctcctgtgcagcctctggattcacctttaatgattatgccatgcactgggtccggcaagctccagggaagggcctggagtgggtctcaggtattagttggagtggtaataacataggctatgcggactctgtgaagggccgattcaccatctccagagacaacgccaagaactccctgtatctgcaaatgaacagtctgagagctgaggacacggccttgtattactgtgcaaaagatagtatacggtatggcatcacctggggaggttttgactactggggccagggaaccctggtcaccgtctcctca

SEQ ID NO: 187 - protein, 106 aa, Artificial Sequence
  Description of Artificial Sequence: Synthetic polypeptide
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLG

SEQ ID NO: 188 - protein, 123 aa, Artificial Sequence
  Description of Artificial Sequence: Synthetic polypeptide
EVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSS

SEQ ID NO: 189 - DNA, 333 bp, Artificial Sequence
  Description of Artificial Sequence: Synthetic polynucleotide
cagcctgtgctgactcagccaccctcggtgtccaagggcttgagacagaccgccacactcacctgcactgggaacagcaacaatgttggcaacctaggagtagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagtagcctcagtgcttgggtgttcggcggagggaccaagctgaccgtcctaggt

SEQ ID NO: 190 - DNA, 354 bp, Artificial Sequence
  Description of Artificial Sequence: Synthetic polynucleotide
gaggtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattaattgggatggtggtagcacctactatgcagactctgtgaagggtcgattcaccatctccagagacaacagcaaaaactccctgtatctgcaaatgaacagtctgagagctgaggacaccgccttgtattactgtgcaaaagggatgggcctgagggcgtttgactactggggccagggaaccctggtcaccgtctcctca

SEQ ID NO: 191 - protein, 111 aa, Artificial Sequence
  Description of Artificial Sequence: Synthetic polypeptide
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLG

SEQ ID NO: 192 - protein, 118 aa, Artificial Sequence
  Description of Artificial Sequence: Synthetic polypeptide
EVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSS

SEQ ID NO: 193 - DNA, 336 bp, Artificial Sequence
  Description of Artificial Sequence: Synthetic polynucleotide
cagtctgtgttgactcagccaccctcagcgtctgggacccccgggcagagggtcaccatctcctgttctggaagcagctccaacatcggaagtaatactgtaaactggtaccagcagctcccaggaacggcccccaaactcctcatctatagtaatgatcagcggccctcaggggtccctgaccgattctctggctccaagtccggcacctcagcctccctggccatcagtgggctccagtctgaggatgaggctgattattactgtgcttcatgggatgacagcctgaatggccgttatgtcttcggaactgggaccaaggtcaccgtcctaggt

SEQ ID NO: 194 - DNA, 366 bp, Artificial Sequence
  Description of Artificial Sequence: Synthetic polynucleotide
caggtccagctggtacagtctggggctgaggtgaggaagcctggggcctcagtgaaggtttcctgcaagacttctggatacaccttcagttggtatgctatacattgggtgcgccaggcccccggacaaaggcttgagtggatgggatggatcaacgctggcaatggaaacacaaaatattcacagaaatttcagggcagagtcagtcttaccagggacacatccgcgagcacagcctacatggagctgagcagcctgagatctgatgacacggctgtgtattactgtgcgagacccgataattatggttcgggtggggatgtttttgatatctggggccaagggacaatggtcaccgtctcttca

SEQ ID NO: 195 - protein, 112 aa, Artificial Sequence
  Description of Artificial Sequence: Synthetic polypeptide
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLG

SEQ ID NO: 196 - protein, 122 aa, Artificial Sequence
  Description of Artificial Sequence: Synthetic polypeptide
QVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDIWGQGTMVTVSS

SEQ ID NO: 197 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactttgtgcagtggtaccagcagcgcccgggcagtgcccccacccctatgatctatgaggataacaacagaccccctggggtccctgatcggttctctgcctccgtcgacagctcctccaactctgcctccctcaccatctctggactgaagactgaggacgaggctgactactactgtcagtcttatgataccagcaatgtggtattcggcggggggaccaagctgaccgtcctaggt

SEQ ID NO: 198 - DNA, 348 bp, Artificial Sequence
  Description of Artificial Sequence: Synthetic polynucleotide
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctca

SEQ ID NO: 199 - protein, 111 aa, Artificial Sequence
  Description of Artificial Sequence: Synthetic polypeptide
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLG

SEQ ID NO: 200 - protein, 116 aa, Artificial Sequence
  Description of Artificial Sequence: Synthetic polypeptide
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSS

SEQ ID NO: 201 - DNA, 333 bp, Artificial Sequence
  Description of Artificial Sequence: Synthetic polynucleotide
caggctgtgctgactcagccaccctcagcgtctggggcccccgggcagagggtcaccgtctcttgttctggaagcaactccaacatcggaagtaactacgttaactggtaccagcagttcccaggaacggcccccaaactcctcatgtatagtagtagtcagcggccctcaggggtccctgaccgattctctggctccaagtctggcacctcagcctccctggccatcagtgggctccactctgaggatgaggctgattattactgtgctacatgggatgacagcctgaatgcttgggtgttcggcggagggaccaagctgaccgtcctaggt

SEQ ID NO: 202 - DNA, 366 bp, Artificial Sequence
  Description of Artificial Sequence: Synthetic polynucleotide
gaggtccagctggtgcagtctggggctgaggtgaggaagcctggggcctcagtgaaggtttcctgcaagacttctggatacaccttcacttggtatgctatacattgggtgcgccaggcccccggacaaaggcttgagtggatgggatggatcaacgctggcagtggaaacacaaaatattcacagaaatttcagggcagagtcacccttaccagggacacatccgcgagcacagcgtacatggagctgagcagcctgagatctgatgacacggctgtgtattactgtgcgagacccaataactatggttcgggtggggatgtttttgatatctggggccaagggacaatggtcaccgtctcttca

SEQ ID NO: 203 - protein, 111 aa, Artificial Sequence
  Description of Artificial Sequence: Synthetic polypeptide
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLG

SEQ ID NO: 204 - protein, 122 aa, Artificial Sequence
  Description of Artificial Sequence: Synthetic polypeptide
EVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDIWGQGTMVTVSS

SEQ ID NO: 205 - DNA, 333 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggt

SEQ ID NO: 206 - DNA, 363 bp, Artificial Sequence
  Description of Artificial Sequence: Synthetic polynucleotide
caggtccagctggtgcagtctggggctgaggtgaagaagcctggggcctcagtgaaagtttcctgcaaggcttctggatacaccttcacgaactatgctctgcattgggtgcgccaggcccccggacaagggcttgagtggatggcatggatcaacggtggcaatggtaacacaaaatattcacagaacttccagggcagagtcaccattaccagggacacatccgcgagcacagcctatatggagctgagcagcctgagatctgaagacacggctgtgtattactgtgcgaaaccggaggaaacagctggaacaatccactttgactactggggccagggaaccccggtcaccgtctcctca

SEQ ID NO: 207 - protein, 111 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLG

SEQ ID NO: 208 - protein, 121 aa, Artificial Sequence
  Description of Artificial Sequence: Synthetic polypeptide
QVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSS

SEQ ID NO: 209 - DNA, 333 bp, Artificial Sequence
  Description of Artificial Sequence: Synthetic polynucleotide
caggctgtgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccatcacggtgttcggcggagggaccaagctgaccgtcctaggt

SEQ ID NO: 210 - DNA, 378 bp, Artificial Sequence
  Description of Artificial Sequence: Synthetic polynucleotide
caggtccagctggtacagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgggggagggttactatgatagtagtggttattccaacggtgatgcttttgatatctggggccaagggacaatggtcaccgtctcttca

SEQ ID NO: 211 - protein, 111 aa, Artificial Sequence
  Description of Artificial Sequence: Synthetic polypeptide
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLG

SEQ ID NO: 212 - protein, 126 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDIWGQGTMVTVSS

SEQ ID NO: 213 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaaggtcaccgtcctaggt

SEQ ID NO: 214 - DNA, 348 bp, Artificial Sequence; identical to SEQ ID NO: 198
  Description of Artificial Sequence: Synthetic polynucleotide

SEQ ID NO: 215 - protein, 111 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLG

SEQ ID NO: 216 - protein, 116 aa, Artificial Sequence; identical to SEQ ID NO: 200
  Description of Artificial Sequence: Synthetic polypeptide

SEQ ID NO: 217 - DNA, 321 bp, Artificial Sequence
  Description of Artificial Sequence: Synthetic polynucleotide
tcctatgtgctgactcagccaccctcagtgtccgtgtccccaggacagacagccagcatcacctgctctggagatagattgacgaataaatatgtttcctggtatcaacagaagccaggccagtcccctgtgttggtcatctatgaggatgccaagcggccctcagggatccctgcgcgattctctggctccaactctgggaacacagccactctgaccatcagcgggacccaggctatggatgagtctgaatattactgtcaggcgtgggacagcagtgtggtggtttttggcggagggaccaagctgaccgtcctaggt

SEQ ID NO: 218 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggatttacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagatgaggacacggccttgtattactgtgcaaaagaccgaggggggggagttatcgttaaggatgcttttgatatctggggccaagggacaatggtcaccgtctcttca

SEQ ID NO: 219 - protein, 107 aa, Artificial Sequence
  Description of Artificial Sequence: Synthetic polypeptide
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLG

SEQ ID NO: 220 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSS

SEQ ID NO: 221 - DNA, 333 bp, Artificial Sequence
  Description of Artificial Sequence: Synthetic polynucleotide
tcctatgagctgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggt

SEQ ID NO: 222 - DNA, 354 bp, Artificial Sequence
  Description of Artificial Sequence: Synthetic polynucleotide
gaggtgcagctggtggagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgccagcagggtggtggttggtacgatgtttggggtcaaggtactctggtcaccgtctcctca

SEQ ID NO: 223 - protein, 111 aa, Artificial Sequence
  Description of Artificial Sequence: Synthetic polypeptide
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLG

SEQ ID NO: 224 - protein, 118 aa, Artificial Sequence
  Description of Artificial Sequence: Synthetic polypeptide
EVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSS

SEQ ID NO: 225 - DNA, 336 bp, Artificial Sequence
  Description of Artificial Sequence: Synthetic polynucleotide
cagtctgtcgtgacgcagccgccctcagtgtctgcggccccaggagagaaggtcaccatctcctgctctggaagcaacttcaatgttggaaataatgatgtatcctggtatcagcaactcccaggtgcagcccccaaactcctcatttatgacaataataagcgaccctcagggattcctgaccgattctctggctccaagtctggcacgtcagccaccctggacatcaccgggctccacagtgacgacgaggccgattattactgcggaacatgggatagcagcctgaatactgggggggtcttcggaactgggaccaaggtcaccgtcctaggt

SEQ ID NO: 226 - DNA, 369 bp, Artificial Sequence
  Description of Artificial Sequence: Synthetic polynucleotide
gaggtccagctggtgcagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctca

SEQ ID NO: 227 - protein, 112 aa, Artificial Sequence
  Description of Artificial Sequence: Synthetic polypeptide
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLG

SEQ ID NO: 228 - protein, 123 aa, Artificial Sequence
  Description of Artificial Sequence: Synthetic polypeptide
EVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 229 - DNA, 336 bp, Artificial Sequence
  Description of Artificial Sequence: Synthetic polynucleotide
cagtctgtgttgacgcagccgccctcagtgtctgcgcccccgggacagaaggtcaccatctcctgctctggaagcagctccaacattgggaataattatgtatcctggtaccagcagttcccaggaacagcccccaaactcctcatttatgacaataataagcgaccctcagggatttctgaccgattctctggctccaagtctggcacgtcagccaccctgggcatcgccggactccagactggggacgaggccgattattactgcggaacatgggataccagcctgagtggtttttatgtcttcggaagtgggaccaaggtcaccgtcctaggt

SEQ ID NO: 230 - DNA, 369 bp, Artificial Sequence
  Description of Artificial Sequence: Synthetic polynucleotide
gaggtccagctggtacagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctca

SEQ ID NO: 231 - protein, 112 aa, Artificial Sequence
  Description of Artificial Sequence: Synthetic polypeptide
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLG

SEQ ID NO: 232 - protein, 123 aa, Artificial Sequence; identical to SEQ ID NO: 228
  Description of Artificial Sequence: Synthetic polypeptide

SEQ ID NO: 233 - DNA, 333 bp, Artificial Sequence
  Description of Artificial Sequence: Synthetic polynucleotide
ctgcctgtgctgactcagccaccctcagcgtctgcgacccccgggcagagggtcaccatctcttgttctggaaccacctccaacatcggaagtaatactgtacactggtaccagcagctcccagggacggcccccaaactcctcatctataataataatcagcggccctcaggggtccctgaccgattctctggctccaagtctggcacctcagcctccctggccatcagtgggctccggtccgaggatgaggctacatattcctgtgcaacatgggatgacagcctgagtggtgtggtcttcggcggagggaccaagctgaccgtcctaggt

SEQ ID NO: 234 - DNA, 369 bp, Artificial Sequence
  Description of Artificial Sequence: Synthetic polynucleotide
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcccgcctacggtgactacgagtatgatgcttttgatatctggggccaagggacaatggtcaccgtctcttca

SEQ ID NO: 235 - protein, 111 aa, Artificial Sequence
  Description of Artificial Sequence: Synthetic polypeptide
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLG

SEQ ID NO: 236 - protein, 123 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDIWGQGTMVTVSS

SEQ ID NO: 237 - DNA, 333 bp, Artificial Sequence
  Description of Artificial Sequence: Synthetic polynucleotide
cagtctgtgttgacgcagccgccctcagcgtctgggacccccgggcagagggtcaccatctcttgttctggaagcagctccaacatcggaactaatggtgtaaactggttccagcagttcccaggaacggcccccaaactcctcatctatactaatgatcagcggccctcaggggtccctgaccgattctctggctccaagtctggcacctcagcctccctggccatcagtgggctccagtctgcggatgaggctgattattactgtgcagtgtgggaccacagcctgaatggtccggtgttcggcggagggaccaagctgaccgtcctaggt

SEQ ID NO: 238 - DNA, 354 bp, Artificial Sequence
  Description of Artificial Sequence: Synthetic polynucleotide
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaggggccggttttgatgcttttgatatctggggccaagggacaatggtcaccgtctcttca

SEQ ID NO: 239 - protein, 111 aa, Artificial Sequence
  Description of Artificial Sequence: Synthetic polypeptide
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLG

SEQ ID NO: 240 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSS

SEQ ID NO: 241 - DNA, 333 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgagactgattattactgtgcagcatgggatgacagcctgaatggttatgtcttcggaactgggaccaaggtcaccgtcctaggt

SEQ ID NO: 242 - DNA, 348 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttca

SEQ ID NO: 243 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLG

SEQ ID NO: 244 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSS

SEQ ID NO: 245 - DNA, 333 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtatagtaatgatcagcggccctcaggggtccctgaccgattctctggctccaagtctggcacctcagcctccctggccatcagtgggctccagtctgaggatgaggctgattattattgtgcagcatgggatgacagcctgaatggttatgtcttcgcagctgggacccagctcaccgttttaagt

SEQ ID NO: 246 - DNA, 348 bp, Artificial Sequence; identical to SEQ ID NO: 242
  Description of Artificial Sequence: Synthetic polynucleotide

SEQ ID NO: 247 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLS

SEQ ID NO: 248 - protein, 116 aa, Artificial Sequence; identical to SEQ ID NO: 244
  Description of Artificial Sequence: Synthetic polypeptide

SEQ ID NO: 249 - DNA, 336 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcactggactccagactggggacgaggccgattattactgcggaacatgggatagcagcctgagtgctgcttatgtcttcggaactgggaccaaggtcaccgtcctaggt

SEQ ID NO: 250 - DNA, 369 bp, Artificial Sequence
  Description of Artificial Sequence: Synthetic polynucleotide
caggtccagctggtacagtctggagctgaggtgaagaagcctggggcctcagtgaaggtctcctgcaaggcttctggttacagctttaccagctatactatcagctgggttcgacaggcccctggacaaggccttgagtggatgggatgggtcagcacttacaatggtctcagaaactatgcacagaacctccagggcagagtcaccatgactacagacacactcacgaccacagcctacatggagctgaggagcctcagatctgacgacacggccgtgtattattgtgtgagagaggggtcccccgactacggtgacttcgcggcctttgactactggggccagggcaccctggtcaccgtctcctca

SEQ ID NO: 251 - protein, 112 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLG

SEQ ID NO: 252 - protein, 123 aa, Artificial Sequence
  Description of Artificial Sequence: Synthetic polypeptide
QVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSS

SEQ ID NO: 253 - DNA, 330 bp, Artificial Sequence
  Description of Artificial Sequence: Synthetic polynucleotide
caggctgtgctgactcagccaccctcagcgtctgagacccccgggcagagggtcaccatctcttgttctggaagcaggtccaacatcggaactaatattgtacactggtaccagcagcgcccaggaatggcccccaaactcctcacttatggtagtcggcggccctcaggggtcccggaccgattctctggctccaagtttggcacctcagcctccctggccatcagtgggctccagtctgaggatgaggctgattattattgtgcagcatgggatgacagtctgaatggtccggctttcggcggagggaccaagctgaccgtcctaggt

SEQ ID NO: 254 - DNA, 348 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagacggtgggggctactttgactactggggccagggaaccctggtcaccgtctcctca

SEQ ID NO: 255 - protein, 110 aa, Artificial Sequence
  Description of Artificial Sequence: Synthetic polypeptide
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLG

SEQ ID NO: 256 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSS

SEQ ID NO: 257 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaatatcggggcacgttatgatgtacactggtaccagcaactcccaggaacagccccccgactcctcatctctgctaactacgatcggccctcaggggtccctgaccgattctctggctccaagtctggcacctcagcctccctggccatcactgggctccaggctgaggatgaggctgattattactgccagtcctatgacagcagtgtgagtgcttgggtgttcggcggagggaccaaggtcaccgtcctaggt

SEQ ID NO: 258 - DNA, 363 bp, Artificial Sequence
  Description of Artificial Sequence: Synthetic polynucleotide
gaagtgcagctggtgcagtctggggctgaagtgaaggagcctggggcctcagtgaggatctcctgccaggcatctggatacaacttcatcagttattatatgcactgggtgcggcaggcccctgggcaaggtcttgagtggatgggcaccatcaacccaggcagtggtgagacagactactcacagaagttgcagggcagagtcaccatgaccagggacccgtccacgggtacattcgacatggggctgagcagcctgacatctggggacacggccgtctattattgtgcgacaggtctcatcagaggagctagcgatgcttttaatatctggggccgggggacaatggtcaccgtctcttca

SEQ ID NO: 259 - protein, 112 aa, Artificial Sequence
  Description of Artificial Sequence: Synthetic polypeptide
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLG

SEQ ID NO: 260 - protein, 121 aa, Artificial Sequence
  Description of Artificial Sequence: Synthetic polypeptide
EVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNIWGRGTMVTVSS

SEQ ID NO: 261 - DNA, 321 bp, Artificial Sequence
  Description of Artificial Sequence: Synthetic polynucleotide
cagcctgtgctgactcagccaccctcagtgtccgtgtccccaggacagacggccgccatcccctgttctggagataagttgggggataaatttgcttcctggtatcagcagaagccaggccagtcccctgtgctggtcatctatcaagatactaagcggccctcagggatccctgagcgattctctggctccaactctgggaacacagccactctgaccatcagcgggacccaggctatggatgaggctgactattactgtcagacgtgggccagcggcattgtggtgttcggcggagggaccaagctgaccgtcctaggt

SEQ ID NO: 262 - DNA, 366 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagcgcagtggctggaagggatttgactactggggccagggaaccctggtcaccgtctcctca

SEQ ID NO: 263 - protein, 107 aa, Artificial Sequence
  Description of Artificial Sequence: Synthetic polypeptide
QPVLTQPPSVSVSPGQTAAIPCSGDKLGDKFASWYQQKPGQSPVLVIYQDTKRPSGIPERFSGSNSGNTATLTISGTQAMDEADYYCQTWASGIVVFGGGTKLTVLG

SEQ ID NO: 264 - protein, 122 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSS

SEQ ID NO: 265 - DNA, 339 bp, Artificial Sequence
  Description of Artificial Sequence: Synthetic polynucleotide
gatgttgtgatgactcagtctccaccctccctgtccgtcacccctggagagccggcctccatcacctgcaggtctagtcagagcctcctggaaagaaatgcatacaactacttggattggtacctgcagaggccaggacagtctccacagctcctgatctacttgggttctaatcgggccgccggggtccctgacaggttcagtggcagtggatcaggcagagattttacactgaaaatcagcagagtggagcctgaggatgttggggtttattactgcatgcaagctctacaagctccgttcactttcggcggagggaccaaggtggagatcaaacgt

SEQ ID NO: 266 - DNA, 357 bp, Artificial Sequence
  Description of Artificial Sequence: Synthetic polynucleotide
gaagtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatggggcccgtttcaggatgcttttgatatctggggccaagggacaatggtcaccgtctcttca

SEQ ID NO: 267 - protein, 113 aa, Artificial Sequence
  Description of Artificial Sequence: Synthetic polypeptide
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKR

SEQ ID NO: 268 - protein, 119 aa, Artificial Sequence
  Description of Artificial Sequence: Synthetic polypeptide
EVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSS

SEQ ID NO: 269 - DNA, 336 bp, Artificial Sequence
  Description of Artificial Sequence: Synthetic polynucleotide
caggctgtgctgactcagcctgcctccgtgtctgggtctcctggacagtcgatcaccatctcctgcactggaaccagcagtgacgttggtggttataactatgtctcctggtaccaacagcacccgggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggagcagggaccaaggtcaccgtcctaggt

SEQ ID NO: 270 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagccaggtggacagcagtggcatcagaccaccactttgactactggggccagggaacgctggtcaccgtctcctca

SEQ ID NO: 271 - protein, 112 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLG

SEQ ID NO: 272 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSS

SEQ ID NO: 273 - DNA, 333 bp, Artificial Sequence
  Description of Artificial Sequence: Synthetic polynucleotide
caggctgtgcttactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaagctgaccgtcctaggt

SEQ ID NO: 274 - DNA, 348 bp, Artificial Sequence
  Description of Artificial Sequence: Synthetic polynucleotide
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagattgggactacatggacgtctggggcaaagggaccacggtcaccgtctcctca

SEQ ID NO: 275 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLG

SEQ ID NO: 276 - protein, 116 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSS

SEQ ID NO: 277 - DNA, 333 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggt

SEQ ID NO: 278 - DNA, 381 bp, Artificial Sequence
  Description of Artificial Sequence: Synthetic polynucleotide
gaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctca

SEQ ID NO: 279 - protein, 111 aa, Artificial Sequence
  Description of Artificial Sequence: Synthetic polypeptide
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLG

SEQ ID NO: 280 - protein, 127 aa, Artificial Sequence
  Description of Artificial Sequence: Synthetic polypeptide
EVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 281 - DNA, 342 bp, Artificial Sequence
  Description of Artificial Sequence: Synthetic polynucleotide
cagtctgtgttgacgcagccgccctcagtgtctggggccccagggcagagggtcaccgtctcctgcactgggagcagatccaacatcggggcaggatatgatgtacactggtaccagcaacttccaggaacagcccccaaactcctcatctatggaaatagtaatcggcctccaggggtccctgaccgattctctgggtctaagtctggcacctcagcctccctggtcatcactgggctccaggctgaggatgccgctgattattactgccagtcctatgacaacactgtgcgtgaatcaccttatgtcttcggaactgggaccaaggtcaccgtcctaggt

SEQ ID NO: 282 - DNA, 375 bp, Artificial Sequence
  Description of Artificial Sequence: Synthetic polynucleotide
gaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagagtaatttagtgtcccggcactactactactacggtatggacgtctggggccaagggaccacggtcaccgtctcctca

SEQ ID NO: 283 - protein, 114 aa, Artificial Sequence
  Description of Artificial Sequence: Synthetic polypeptide
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLG

SEQ ID NO: 284 - protein, 125 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSS

SEQ ID NO: 285 - DNA, 333 bp, Artificial Sequence
  Description of Artificial Sequence: Synthetic polynucleotide
ctgcctgtgctgactcagccaccctcagcgtctgggacccccgggcagagggtcaccatctcttgttctggaaccagctccaacatcggaagtaattctgtagactggtaccagcagctcccaggaacggcccccaaactcctcatctatagtaataatcagcggccctcaggggtccctgaccgaatctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggt

SEQ ID NO: 286 - DNA, 396 bp, Artificial Sequence
  Description of Artificial Sequence: Synthetic polynucleotide
gaagtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagattacggatactatggttcggggagttattcgagcggccccctttactactactacggtatggacgtctggggccaagggaccacggtcaccgtctcctca

SEQ ID NO: 287 - protein, 111 aa, Artificial Sequence
  Description of Artificial Sequence: Synthetic polypeptide
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLG

SEQ ID NO: 288 - protein, 132 aa, Artificial Sequence
  Description of Artificial Sequence: Synthetic polypeptide
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSS

SEQ ID NO: 289 - DNA, 333 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtataataatgatcagcggccctcaggggtccctgaccgattctctggctccaagtctggcacctcagcctccctggccatcagtgggctccagtctgaggatgaggctgattattactgtgcagcatgggatgacagcctcaatggttatgtcttcggacctgggaccaaggtcaccgtcctaggt

SEQ ID NO: 290 - DNA, 381 bp, Artificial Sequence
  Description of Artificial Sequence: Synthetic polynucleotide
caggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctca

SEQ ID NO: 291 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLG

SEQ ID NO: 292 - protein, 127 aa, Artificial Sequence
  Description of Artificial Sequence: Synthetic polypeptide
QVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 293 - DNA, 333 bp, Artificial Sequence
  Description of Artificial Sequence: Synthetic polynucleotide
aattttatgctgactcagccccacgctgtgtcggagtctccggggaagacggtaaccatctcctgcacccgcagcagtggcagtattgccagcaactatgtgcagtggtaccagcagcgcccgggcagttccccccgcactgtgatttatgaggataatcaaagaccctctggggtccctggtcggttctctggctccatcgacagctcctccaactctgcctccctcaccatctctggactgaagactgaggacgaggctgactactactgtcagtcttatgattccaccagtgtgcttttcggcggagggaccaagctgaccgtcctaggt

SEQ ID NO: 294 - DNA, 360 bp, Artificial Sequence
  Description of Artificial Sequence: Synthetic polynucleotide
gaggtccagctggtgcagtctggggctgaggtgaagaagccagggtcctcggtgaaggtctcctgcaaggcctcgggaggcaccttcagcagcaattctctcagctgggtgcgacaggcccctggacaagggcttgagtggatgggaaggatcttccctatcctgggtataacaaactatgcacagaagttccagggcagagtcacgattaccgcggacaaatccacgagcacagcctacatggagctgagcagcctgagatctgaggacacggccgtctattactgtgcgagaggaaactaccaatggtatgatgcttttgatatctggggccaagggacaatggtcaccgtctcttca

SEQ ID NO: 295 - protein, 111 aa, Artificial Sequence
  Description of Artificial Sequence: Synthetic polypeptide
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLG

SEQ ID NO: 296 - protein, 120 aa, Artificial Sequence
  Description of Artificial Sequence: Synthetic polypeptide
EVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDIWGQGTMVTVSS

SEQ ID NO: 297 - DNA, 330 bp, Artificial Sequence
  Description of Artificial Sequence: Synthetic polynucleotide
cagcctgtgctgactcagccaccctcagtgtcagtggtcccaggaaagacggccaggattacctgtgggggaaaaaacattggaagtaaaagtgtgcactggtaccagcagaagccaggccaggcccctgtggtggtcatccattatgatagtgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggt

SEQ ID NO: 298 - DNA, 351 bp, Artificial Sequence
  Description of Artificial Sequence: Synthetic polynucleotide
caggtgcagctggtgcagtctggagctgaggtgaagaagcctggggcctcagtgaaggtctcctgcaaggcttctggttacacctttaccaactatggtatcagctgggtgcgacaggcccctggacaagggcttgagtggatgggatggatcagcgcttacaatggtaacacaaactatgcacataagctccagggcagagtcaccatgaccacagacacatccacgagcacagccaacatggagctgaggagcctgagacctgacgacactgccgtgtattactgtgcgcgctcttacttcggttctcatgattactggggtcaaggtactctggtgaccgtctcctca

SEQ ID NO: 299 - protein, 110 aa, Artificial Sequence
  Description of Artificial Sequence: Synthetic polypeptide
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLG

SEQ ID NO: 300 - protein, 117 aa, Artificial Sequence
  Description of Artificial Sequence: Synthetic polypeptide
QVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSS

SEQ ID NO: 301 - DNA, 327 bp, Artificial Sequence
  Description of Artificial Sequence: Synthetic polynucleotide
tcctatgtgctgactcagccaccctcggtgtcagtggccccaggaaagacggccaggatttcctgtgggggaaacgacattggaagtaaaagtgttttctggtatcagcagaggccaggccaggcccctgtgttggtcgtctatgatgatagcgaccggccctcagggctccctgagcgattctctggcttcaactctgggaacacggccaccctgaccatcagcagggtcgaagccggggatgaggccgactattactgtcaagtgtgggatagtagtagtgatcattatgtcttcggaactgggaccaaggtcaccgtcctaggt

SEQ ID NO: 302 - DNA, 369 bp, Artificial Sequence
  Description of Artificial Sequence: Synthetic polynucleotide
caggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataacctatggttcggggagttatggtgcttttgatatctggggccaagggacaatggtcaccgtctcttca

SEQ ID NO: 303 - protein, 109 aa, Artificial Sequence
  Description of Artificial Sequence: Synthetic polypeptide
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLG

SEQ ID NO: 304 - protein, 123 aa, Artificial Sequence
  Description of Artificial Sequence: Synthetic polypeptide
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSS

SEQ ID NO: 305 - DNA, 63 bp, Artificial Sequence
  Description of Artificial Sequence: Synthetic oligonucleotide
tctagaggtggtggtggtagcggcggcggcggctctggtggtggtggatccctcgagatggcc

SEQ ID NO: 306 - DNA, 75 bp, Artificial Sequence
  Description of Artificial Sequence: Synthetic oligonucleotide
actagtggccaggccggccagcaccatcaccatcaccatggcgcatacccgtacgacgttccggactacgcttct

SEQ ID NO: 307 - protein, 21 aa, Artificial Sequence
  Description of Artificial Sequence: Synthetic peptide
SRGGGGSGGGGSGGGGSLEMA

SEQ ID NO: 308 - protein, 25 aa, Artificial Sequence
  Description of Artificial Sequence: Synthetic peptide
TSGQAGQHHHHHHGAYPYDVPDYAS

SEQ ID NO: 309 - protein, 8 aa, Artificial Sequence
  Description of Artificial Sequence: Synthetic peptide
GGSFSGYY

SEQ ID NO: 310 - protein, 7 aa, Artificial Sequence
  Description of Artificial Sequence: Synthetic peptide
INHSGST

SEQ ID NO: 311 - protein, 11 aa, Artificial Sequence
  Description of Artificial Sequence: Synthetic peptide
AREGPYDGFDS

SEQ ID NO: 312 - protein, 8 aa, Artificial Sequence
  Description of Artificial Sequence: Synthetic peptide
SSNIGSNT

SEQ ID NO: 313 - protein, 3 aa, Artificial Sequence
  Description of Artificial Sequence: Synthetic peptide
SNN

SEQ ID NO: 314 - protein, 11 aa, Artificial Sequence
  Description of Artificial Sequence: Synthetic peptide
AAWDDSLNGYV

SEQ ID NO: 315 - protein, 8 aa, Artificial Sequence
  Description of Artificial Sequence: Synthetic peptide
GYPFNKYD

SEQ ID NO: 316 - protein, 8 aa, Artificial Sequence
  Description of Artificial Sequence: Synthetic peptide
IIPIFRTT

SEQ ID NO: 317 - protein, 9 aa, Artificial Sequence
  Description of Artificial Sequence: Synthetic peptide
AREWFYWDI

SEQ ID NO: 318 - protein, 8 aa, Artificial Sequence
  Description of Artificial Sequence: Synthetic peptide
SGSIASNY

SEQ ID NO: 319 - protein, 3 aa, Artificial Sequence
  Description of Artificial Sequence: Synthetic peptide
EDN

SEQ ID NO: 320 - protein, 10 aa, Artificial Sequence
  Description of Artificial Sequence: Synthetic peptide
QSYDSSNSVV

SEQ ID NO: 321 - protein, 8 aa, Artificial Sequence
  Description of Artificial Sequence: Synthetic peptide
GFTFSSYG

SEQ ID NO: 322 - protein, 8 aa, Artificial Sequence
  Description of Artificial Sequence: Synthetic peptide
ISHDGSNK

SEQ ID NO: 323 - protein, 14 aa, Artificial Sequence
  Description of Artificial Sequence: Synthetic peptide
ARSNQWSGYFSFDY

SEQ ID NO: 324 - protein, 6 aa, Artificial Sequence
  Description of Artificial Sequence: Synthetic peptide
KLGTKY

SEQ ID NO: 325 - protein, 10 aa, Artificial Sequence
  Description of Artificial Sequence: Synthetic peptide
QAWDSDTFVV

SEQ ID NO: 326 - protein, 8 aa, Artificial Sequence
  Description of Artificial Sequence: Synthetic peptide
GYTFTNYG

SEQ ID NO: 327 - protein, 8 aa, Artificial Sequence
  Description of Artificial Sequence: Synthetic peptide
ISAYNGNT

SEQ ID NO: 328 - protein, 10 aa, Artificial Sequence
  Description of Artificial Sequence: Synthetic peptide
ARSYFGSHDY

SEQ ID NO: 329 - protein, 6 aa, Artificial Sequence
  Description of Artificial Sequence: Synthetic peptide
NIGSKS

SEQ ID NO: 330 - protein, 3 aa, Artificial Sequence
  Description of Artificial Sequence: Synthetic peptide
YDS

SEQ ID NO: 331 - protein, 12 aa, Artificial Sequence
  Description of Artificial Sequence: Synthetic peptide
QVWDSSSDHPYV

SEQ ID NO: 332 - protein, 8 aa, Artificial Sequence
  Description of Artificial Sequence: Synthetic peptide
GYTFTTYG

SEQ ID NO: 333 - protein, 8 aa, Artificial Sequence
  Description of Artificial Sequence: Synthetic peptide
INTYNGHT

SEQ ID NO: 334 - protein, 10 aa, Artificial Sequence
  Description of Artificial Sequence: Synthetic peptide
ARVIYGSGDY

SEQ ID NO: 335 - protein, 9 aa, Artificial Sequence
  Description of Artificial Sequence: Synthetic peptide
GYSISSGYF

SEQ ID NO: 336 - protein, 7 aa, Artificial Sequence
  Description of Artificial Sequence: Synthetic peptide
IYHSRST

SEQ ID NO: 337 - protein, 9 aa, Artificial Sequence
  Description of Artificial Sequence: Synthetic peptide
ARGYGYFDY

SEQ ID NO: 338 - protein, 6 aa, Artificial Sequence
  Description of Artificial Sequence: Synthetic peptide
NIGSKT

SEQ ID NO: 339 - protein, 11 aa, Artificial Sequence
  Description of Artificial Sequence: Synthetic peptide
QVWDSSSDHRV

SEQ ID NO: 340 - protein, 8 aa, Artificial Sequence
  Description of Artificial Sequence: Synthetic peptide
GFTFGDYG

SEQ ID NO: 341 - protein, 8 aa, Artificial Sequence
  Description of Artificial Sequence: Synthetic peptide
INWNGGST

SEQ ID NO: 342 - protein, 13 aa, Artificial Sequence
  Description of Artificial Sequence: Synthetic peptide
ARSKYNFHVYYDY

SEQ ID NO: 343 - protein, 9 aa, Artificial Sequence
  Description of Artificial Sequence: Synthetic peptide
SSDVGGYNY

SEQ ID NO: 344 - protein, 3 aa, Artificial Sequence
  Description of Artificial Sequence: Synthetic peptide
DVS

SEQ ID NO: 345 - protein, 11 aa, Artificial Sequence
  Description of Artificial Sequence: Synthetic peptide
SSYTSSSTSKV

SEQ ID NO: 346 - protein, 8 aa, Artificial Sequence
  Description of Artificial Sequence: Synthetic peptide
GYTFTSYG

SEQ ID NO: 347 - protein, 13 aa, Artificial Sequence
  Description of Artificial Sequence: Synthetic peptide
ARSSGNMVSWKDM

SEQ ID NO: 348 - protein, 8 aa, Artificial Sequence
  Description of Artificial Sequence: Synthetic peptide
NSNIGSNY

SEQ ID NO: 349 - protein, 3 aa, Artificial Sequence
  Description of Artificial Sequence: Synthetic peptide
RNN

SEQ ID NO: 350 - protein, 11 aa, Artificial Sequence
  Description of Artificial Sequence: Synthetic peptide
AAWDDSLSAYV

SEQ ID NO: 351 - protein, 9 aa, Artificial Sequence
  Description of Artificial Sequence: Synthetic peptide
ARGAVAYHD

SEQ ID NO: 352 - protein, 9 aa, Artificial Sequence
  Description of Artificial Sequence: Synthetic peptide
SSDVGGYNS

SEQ ID NO: 353 - protein, 11 aa, Artificial Sequence
  Description of Artificial Sequence: Synthetic peptide
SSYTSSSTPLV

SEQ ID NO: 354 - protein, 8 aa, Artificial Sequence
  Description of Artificial Sequence: Synthetic peptide
GGTLSSYA

SEQ ID NO: 355 - protein, 8 aa, Artificial Sequence
  Description of Artificial Sequence: Synthetic peptide
IIPMFGTA

SEQ ID NO: 356 - protein, 11 aa, Artificial Sequence
  Description of Artificial Sequence: Synthetic peptide
ARGVHYASFDH

SEQ ID NO: 357 - protein, 8 aa, Artificial Sequence
  Description of Artificial Sequence: Synthetic peptide
SSNISIYD

SEQ ID NO: 358 - protein, 3 aa, Artificial Sequence
  Description of Artificial Sequence: Synthetic peptide
GNN

SEQ ID NO: 359 - protein, 11 aa, Artificial Sequence
  Description of Artificial Sequence: Synthetic peptide
GTWDDSLSGGV

SEQ ID NO: 360 - protein, 8 aa, Artificial Sequence
  Description of Artificial Sequence: Synthetic peptide
GFPFNIFG

SEQ ID NO: 361 - protein, 8 aa, Artificial Sequence
  Description of Artificial Sequence: Synthetic peptide
ISGYNGNT

SEQ ID NO: 362 - protein, 10 aa, Artificial Sequence
  Description of Artificial Sequence: Synthetic peptide
ARGAYGGMDT

SEQ ID NO: 363 - protein, 8 aa, Artificial Sequence
  Description of Artificial Sequence: Synthetic peptide
DSNIGNNY

SEQ ID NO: 364 - protein, 3 aa, Artificial Sequence
  Description of Artificial Sequence: Synthetic peptide
DVK

SEQ ID NO: 365 - protein, 11 aa, Artificial Sequence
  Description of Artificial Sequence: Synthetic peptide
GTWDSRLDAYV

SEQ ID NO: 366 - protein, 8 aa, Artificial Sequence
  Description of Artificial Sequence: Synthetic peptide
GYMFTSYG

SEQ ID NO: 367 - protein, 8 aa, Artificial Sequence
  Description of Artificial Sequence: Synthetic peptide
ISANNGKT

SEQ ID NO: 368 - protein, 11 aa, Artificial Sequence
  Description of Artificial Sequence: Synthetic peptide
ARHIGGSYFDR

SEQ ID NO: 369 - protein, 9 aa, Artificial Sequence
  Description of Artificial Sequence: Synthetic peptide
TSNIGAGYD

SEQ ID NO: 370 - protein, 3 aa, Artificial Sequence
  Description of Artificial Sequence: Synthetic peptide
TNN

SEQ ID NO: 371 - protein, 11 aa, Artificial Sequence
  Description of Artificial Sequence: Synthetic peptide
GTWDSSLSAVV

SEQ ID NO: 372 - protein, 8 aa, Artificial Sequence
  Description of Artificial Sequence: Synthetic peptide
GFTFSSYA

SEQ ID NO: 373 - protein, 8 aa, Artificial Sequence
  Description of Artificial Sequence: Synthetic peptide
ISGSDGST

SEQ ID NO: 374 - protein, 12 aa, Artificial Sequence
  Description of Artificial Sequence: Synthetic peptide
ARSHEANLVGDW

SEQ ID NO: 375 - protein, 11 aa, Artificial Sequence
  Description of Artificial Sequence: Synthetic peptide
QVWDSSSDHYV

SEQ ID NO: 376 - protein, 11 aa, Artificial Sequence
  Description of Artificial Sequence: Synthetic peptide
ARWGGFGAVDH

SEQ ID NO: 377 - protein, 10 aa, Artificial Sequence
  Description of Artificial Sequence: Synthetic peptide
QVWDSSSDVV

SEQ ID NO: 378 - protein, 8 aa, Artificial Sequence
  Description of Artificial Sequence: Synthetic peptide
GFTFSSYS

SEQ ID NO: 379 - protein, 8 aa, Artificial Sequence
  Description of Artificial Sequence: Synthetic peptide
ISSSSSYI

SEQ ID NO: 380 - protein, 8 aa, Artificial Sequence
  Description of Artificial Sequence: Synthetic peptide
ARGQGYDY

SEQ ID NO: 381 - protein, 6 aa, Artificial Sequence
  Description of Artificial Sequence: Synthetic peptide
SLTDYH

SEQ ID NO: 382 - protein, 3 aa, Artificial Sequence
  Description of Artificial Sequence: Synthetic peptide
ATN

SEQ ID NO: 383 - protein, 11 aa, Artificial Sequence
  Description of Artificial Sequence: Synthetic peptide
NSRDSGTDEVL

SEQ ID NO: 384 - protein, 9 aa, Artificial Sequence
  Description of Artificial Sequence: Synthetic peptide
ARYYPGMDM

SEQ ID NO: 385 - protein, 3 aa, Artificial Sequence
  Description of Artificial Sequence: Synthetic peptide
DDS

SEQ ID NO: 386 - protein, 11 aa, Artificial Sequence
  Description of Artificial Sequence: Synthetic peptide
QVWDSSSDHTV

SEQ ID NO: 387 - protein, 8 aa, Artificial Sequence
  Description of Artificial Sequence: Synthetic peptide
GYTLNELS

SEQ ID NO: 388 - protein, 8 aa, Artificial Sequence
  Description of Artificial Sequence: Synthetic peptide
FDPEDGET

SEQ ID NO: 389 - protein, 8 aa, Artificial Sequence
  Description of Artificial Sequence: Synthetic peptide
ARGGYGDS

SEQ ID NO: 390 - protein, 8 aa, Artificial Sequence
  Description of Artificial Sequence: Synthetic peptide
SSNIGRNG

SEQ ID NO: 391 - protein, 3 aa, Artificial Sequence
  Description of Artificial Sequence: Synthetic peptide
NDN

SEQ ID NO: 392 - protein, 11 aa, Artificial Sequence
  Description of Artificial Sequence: Synthetic peptide
AAWDDSLHGVV

SEQ ID NO: 393 - protein, 8 aa, Artificial Sequence
  Description of Artificial Sequence: Synthetic peptide
GGTFSSDA

SEQ ID NO: 394 - protein, 25 aa, Artificial Sequence
  Description of Artificial Sequence: Synthetic peptide
AREGYYYPSAYLGSVLNDISSVYDE

SEQ ID NO: 395 - protein, 10 aa, Artificial Sequence
  Description of Artificial Sequence: Synthetic peptide
QSYDSSNSWV

SEQ ID NO: 396 - protein, 9 aa, Artificial Sequence
  Description of Artificial Sequence: Synthetic peptide
ARSMTSFDY

SEQ ID NO: 397 - protein, 8 aa, Artificial Sequence
  Description of Artificial Sequence: Synthetic peptide
TSNIGNND

SEQ ID NO: 398 - protein, 3 aa, Artificial Sequence
  Description of Artificial Sequence: Synthetic peptide
DNN

SEQ ID NO: 399 - protein, 10 aa, Artificial Sequence
  Description of Artificial Sequence: Synthetic peptide
GTWDSSVSAS

SEQ ID NO: 400 - protein, 9 aa, Artificial Sequence
  Description of Artificial Sequence: Synthetic peptide
ARSVYDLDT

SEQ ID NO: 401 - protein, 8 aa, Artificial Sequence
  Description of Artificial Sequence: Synthetic peptide
NSNIGNNY

SEQ ID NO: 402 - protein, 12 aa, Artificial Sequence
  Description of Artificial Sequence: Synthetic peptide
GTWNTTVTPGYV

SEQ ID NO: 403 - protein, 8 aa, Artificial Sequence
  Description of Artificial Sequence: Synthetic peptide
GFTFDDYA

SEQ ID NO: 404 - protein, 8 aa, Artificial Sequence
  Description of Artificial Sequence: Synthetic peptide
ISWNSGSI

SEQ ID NO: 405 - protein, 12 aa, Artificial Sequence
  Description of Artificial Sequence: Synthetic peptide
ARYRQVGSAYDS

SEQ ID NO: 406 - protein, 8 aa, Artificial Sequence
  Description of Artificial Sequence: Synthetic peptide
SSNIGNNY

SEQ ID NO: 407 - protein, 12 aa, Artificial Sequence
  Description of Artificial Sequence: Synthetic peptide
GTWDSSLGAPYV

SEQ ID NO: 408 - protein, 11 aa, Artificial Sequence
  Description of Artificial Sequence: Synthetic peptide
ARYWGFGVSDR

SEQ ID NO: 409 - protein, 3 aa, Artificial Sequence
  Description of Artificial Sequence: Synthetic peptide
ADS

SEQ ID NO: 410 - protein, 12 aa, Artificial Sequence
  Description of Artificial Sequence: Synthetic peptide
QVWDSSSYHNYV

SEQ ID NO: 411 - protein, 8 aa, Artificial Sequence
  Description of Artificial Sequence: Synthetic peptide
GGTFSSYA

SEQ ID NO: 412 - protein, 8 aa, Artificial Sequence
  Description of Artificial Sequence: Synthetic peptide
IIPIFGTA

SEQ ID NO: 413 - protein, 10 aa, Artificial Sequence
  Description of Artificial Sequence: Synthetic peptide
ARYNYYYYDS

SEQ ID NO: 414 - protein, 10 aa, Artificial Sequence
  Description of Artificial Sequence: Synthetic peptide
QSYDSSNLWV

SEQ ID NO: 415 - protein, 11 aa, Artificial Sequence
  Description of Artificial Sequence: Synthetic peptide
ARYWGYDSYDE

SEQ ID NO: 416 - protein, 6 aa, Artificial Sequence
  Description of Artificial Sequence: Synthetic peptide
QSISSY

SEQ ID NO: 417 - protein, 3 aa, Artificial Sequence
  Description of Artificial Sequence: Synthetic peptide
AAS

SEQ ID NO: 418 - protein, 9 aa, Artificial Sequence
  Description of Artificial Sequence: Synthetic peptide
QQSYSTPFT

SEQ ID NO: 419 - protein, 9 aa, Artificial Sequence
  Description of Artificial Sequence: Synthetic peptide
QSYDSSNWV

SEQ ID NO: 420 - protein, 8 aa, Artificial Sequence
  Description of Artificial Sequence: Synthetic peptide
GYTFTDYY

SEQ ID NO: 421 - protein, 8 aa, Artificial Sequence
  Description of Artificial Sequence: Synthetic peptide
VDPEDGET

SEQ ID NO: 422 - protein, 19 aa, Artificial Sequence
  Description of Artificial Sequence: Synthetic peptide
ARYWSYSFDYLYMPEGNDW

SEQ ID NO: 423 - protein, 9 aa, Artificial Sequence
  Description of Artificial Sequence: Synthetic peptide
SSNIGAGYD

SEQ ID NO: 424 - protein, 11 aa, Artificial Sequence
  Description of Artificial Sequence: Synthetic peptide
QSYDSSLSDVV

SEQ ID NO: 425 - protein, 8 aa, Artificial Sequence
  Description of Artificial Sequence: Synthetic peptide
GYNFLNYG

SEQ ID NO: 426 - protein, 8 aa, Artificial Sequence
  Description of Artificial Sequence: Synthetic peptide
ISTYTGNT

SEQ ID NO: 427 - protein, 12 aa, Artificial Sequence
  Description of Artificial Sequence: Synthetic peptide
ARDLYYYEGVDY

SEQ ID NO: 428 - protein, 8 aa, Artificial Sequence
  Description of Artificial Sequence: Synthetic peptide
VSNIGSGA

SEQ ID NO: 429 - protein, 3 aa, Artificial Sequence
  Description of Artificial Sequence: Synthetic peptide
SYN

SEQ ID NO: 430 - protein, 9 aa, Artificial Sequence
  Description of Artificial Sequence: Synthetic peptide
ATWDDSVNG

SEQ ID NO: 431 - protein, 8 aa, Artificial Sequence
  Description of Artificial Sequence: Synthetic peptide
ISYDGSNK

SEQ ID NO: 432 - protein, 12 aa, Artificial Sequence
  Description of Artificial Sequence: Synthetic peptide
ARSYFTSGFYDY

SEQ ID NO: 433 - protein, 6 aa, Artificial Sequence
  Description of Artificial Sequence: Synthetic peptide
NIGSES

SEQ ID NO: 434 - protein, 3 aa, Artificial Sequence
  Description of Artificial Sequence: Synthetic peptide
YDT

SEQ ID NO: 435 - protein, 11 aa, Artificial Sequence
  Description of Artificial Sequence: Synthetic peptide
QVWDSSRDHVV

SEQ ID NO: 436 - protein, 8 aa, Artificial Sequence
  Description of Artificial Sequence: Synthetic peptide
GYTLTELS

SEQ ID NO: 437 - protein, 9 aa, Artificial Sequence
  Description of Artificial Sequence: Synthetic peptide
ARMSSMYYD

SEQ ID NO: 438 - protein, 3 aa, Artificial Sequence
  Description of Artificial Sequence: Synthetic peptide
GNS

SEQ ID NO: 439 - protein, 12 aa, Artificial Sequence
  Description of Artificial Sequence: Synthetic peptide
QSYDSSLSGSYV

SEQ ID NO: 440 - protein, 8 aa, Artificial Sequence
  Description of Artificial Sequence: Synthetic peptide
GFTVSDYY

SEQ ID NO: 441 - protein, 8 aa, Artificial Sequence
  Description of Artificial Sequence: Synthetic peptide
ISGSGNSI

SEQ ID NO: 442 - protein, 8 aa, Artificial Sequence
  Description of Artificial Sequence: Synthetic peptide
ARSTKFDY

SEQ ID NO: 443 - protein, 10 aa, Artificial Sequence
  Description of Artificial Sequence: Synthetic peptide
QVWDSSSDYV

SEQ ID NO: 444 - protein, 8 aa, Artificial Sequence
  Description of Artificial Sequence: Synthetic peptide
GYSFTNYW

SEQ ID NO: 445 - protein, 8 aa, Artificial Sequence
  Description of Artificial Sequence: Synthetic peptide
IYPGDSDT

SEQ ID NO: 446 - protein, 12 aa, Artificial Sequence
  Description of Artificial Sequence: Synthetic peptide
ARSTGSSHMSDE

SEQ ID NO: 447 - protein, 8 aa, Artificial Sequence
  Description of Artificial Sequence: Synthetic peptide
SSNVGSYT

SEQ ID NO: 448 - protein, 3 aa, Artificial Sequence
  Description of Artificial Sequence: Synthetic peptide
NNN

SEQ ID NO: 449 - protein, 11 aa, Artificial Sequence
  Description of Artificial Sequence: Synthetic peptide
AAWDDRLGGYV

SEQ ID NO: 450 - protein, 7 aa, Artificial Sequence
  Description of Artificial Sequence: Synthetic peptide
ITHSGRS

SEQ ID NO: 451 - protein, 9 aa, Artificial Sequence
  Description of Artificial Sequence: Synthetic peptide
ARSSIMSDY

SEQ ID NO: 452 - protein, 10 aa, Artificial Sequence
  Description of Artificial Sequence: Synthetic peptide
QSYDSSNHWV

SEQ ID NO: 453 - protein, 11 aa, Artificial Sequence
  Description of Artificial Sequence: Synthetic peptide
ARGSALDHYDR

SEQ ID NO: 454 - protein, 3 aa, Artificial Sequence
  Description of Artificial Sequence: Synthetic peptide
NNR

SEQ ID NO: 455 - protein, 11 aa, Artificial Sequence
  Description of Artificial Sequence: Synthetic peptide
GTWDGSLTGAV

SEQ ID NO: 456 - protein, 10 aa, Artificial Sequence
  Description of Artificial Sequence: Synthetic peptide
ARYNYYFNDY

SEQ ID NO: 457 - protein, 9 aa, Artificial Sequence
  Description of Artificial Sequence: Synthetic peptide
QSYDSTNWV

SEQ ID NO: 458 - protein, 10 aa, Artificial Sequence
  Description of Artificial Sequence: Synthetic peptide
ARSMFGAHDS

SEQ ID NO: 459 - protein, 11 aa, Artificial Sequence
  Description of Artificial Sequence: Synthetic peptide
ARGASFDRHDN

SEQ ID NO: 460 - protein, 9 aa, Artificial Sequence
  Description of Artificial Sequence: Synthetic peptide
SSNIGAGFD

SEQ ID NO: 461 - protein, 3 aa, Artificial Sequence
  Description of Artificial Sequence: Synthetic peptide
ANS

SEQ ID NO: 462 - protein, 11 aa, Artificial Sequence
  Description of Artificial Sequence: Synthetic peptide
QSYDSSLSGVV

SEQ ID NO: 463 - protein, 10 aa, Artificial Sequence
  Description of Artificial Sequence: Synthetic peptide
ARSNYYYNDY

SEQ ID NO: 464 - protein, 9 aa, Artificial Sequence
  Description of Artificial Sequence: Synthetic peptide
ARYSGVYYD

SEQ ID NO: 465 - protein, 11 aa, Artificial Sequence
  Description of Artificial Sequence: Synthetic peptide
QSYDSSLSGYV

SEQ ID NO: 466 - protein, 8 aa, Artificial Sequence
  Description of Artificial Sequence: Synthetic peptide
MNPNSGNT

SEQ ID NO: 467 - protein, 9 aa, Artificial Sequence
  Description of Artificial Sequence: Synthetic peptide
ARYYSYGYD

SEQ ID NO: 468 - protein, 8 aa, Artificial Sequence
  Description of Artificial Sequence: Synthetic peptide
SGSIADNF

SEQ ID NO: 469 - protein, 3 aa, Artificial Sequence
  Description of Artificial Sequence: Synthetic peptide
NDD

SEQ ID NO: 470 - protein, 10 aa, Artificial Sequence
  Description of Artificial Sequence: Synthetic peptide
QSYDNNNRGV

SEQ ID NO: 471 - protein, 10 aa, Artificial Sequence
  Description of Artificial Sequence: Synthetic peptide
GDSVSTNSVA

SEQ ID NO: 472 - protein, 9 aa, Artificial Sequence
  Description of Artificial Sequence: Synthetic peptide
TYYRSKWSN

SEQ ID NO: 473 - protein, 12 aa, Artificial Sequence
  Description of Artificial Sequence: Synthetic peptide
ARSSSWYQIFDY

SEQ ID NO: 474 - protein, 9 aa, Artificial Sequence
  Description of Artificial Sequence: Synthetic peptide
SSNIGTGYF

SEQ ID NO: 475 - protein, 8 aa, Artificial Sequence
  Description of Artificial Sequence: Synthetic peptide
ISGSGGST

SEQ ID NO: 476 - protein, 14 aa, Artificial Sequence
  Description of Artificial Sequence: Synthetic peptide
ARSGAYWDYSVYDE

SEQ ID NO: 477 - protein, 8 aa, Artificial Sequence
  Description of Artificial Sequence: Synthetic peptide
SDSIANNY

SEQ ID NO: 478 - protein, 3 aa, Artificial Sequence
  Description of Artificial Sequence: Synthetic peptide
EDV

SEQ ID NO: 479 - protein, 10 aa, Artificial Sequence
  Description of Artificial Sequence: Synthetic peptide
QSYHSDNRWV

SEQ ID NO: 480 - protein, 9 aa, Artificial Sequence
  Description of Artificial Sequence: Synthetic peptide
GGSISSSNW

SEQ ID NO: 481 - protein, 7 aa, Artificial Sequence
  Description of Artificial Sequence: Synthetic peptide
IYHSGSP

SEQ ID NO: 482 - protein, 12 aa, Artificial Sequence
  Description of Artificial Sequence: Synthetic peptide
ARMTTHTFGYDA

SEQ ID NO: 483 - protein, 6 aa, Artificial Sequence
  Description of Artificial Sequence: Synthetic peptide
KLGDKY

SEQ ID NO: 484 - protein, 3 aa, Artificial Sequence
  Description of Artificial Sequence: Synthetic peptide
QDN

SEQ ID NO: 485 - protein, 10 aa, Artificial Sequence
  Description of Artificial Sequence: Synthetic peptide
QAWDSSTYVA

SEQ ID NO: 486 - protein, 8 aa, Artificial Sequence
  Description of Artificial Sequence: Synthetic peptide
ARGVHLDW

SEQ ID NO: 487 - protein, 3 aa, Artificial Sequence
  Description of Artificial Sequence: Synthetic peptide
DDA

SEQ ID NO: 488 - protein, 11 aa, Artificial Sequence
  Description of Artificial Sequence: Synthetic peptide
QVWDRNSAQFV

SEQ ID NO: 489 - protein, 19 aa, Artificial Sequence
  Description of Artificial Sequence: Synthetic peptide
ARLYEGGYHGWGSWLSSDS

SEQ ID NO: 490 - protein, 8 aa, Artificial Sequence
  Description of Artificial Sequence: Synthetic peptide
SSNIGSNY

SEQ ID NO: 491 - protein, 11 aa, Artificial Sequence
  Description of Artificial Sequence: Synthetic peptide
AAWDDSLSGYV

SEQ ID NO: 492 - protein, 11 aa, Artificial Sequence
  Description of Artificial Sequence: Synthetic peptide
AREGAFDAFDI

SEQ ID NO: 493 - protein, 10 aa, Artificial Sequence
  Description of Artificial Sequence: Synthetic peptide
AAWDDSLNGY

SEQ ID NO: 494 - protein, 13 aa, Artificial Sequence
  Description of Artificial Sequence: Synthetic peptide
ANGDSNYYYGMDV

SEQ ID NO: 495 - protein, 11 aa, Artificial Sequence
  Description of Artificial Sequence: Synthetic peptide
AAWDDSLSGYL

SEQ ID NO: 496 - protein, 8 aa, Artificial Sequence
  Description of Artificial Sequence: Synthetic peptide
ISGDGGST

SEQ ID NO: 497 - protein, 16 aa, Artificial Sequence
  Description of Artificial Sequence: Synthetic peptide
AKDRAAAGYYYYGMDV

SEQ ID NO: 498 - protein, 9 aa, Artificial Sequence
  Description of Artificial Sequence: Synthetic peptide
SSDIGGYNY

SEQ ID NO: 499 - protein, 11 aa, Artificial Sequence
  Description of Artificial Sequence: Synthetic peptide
ISYTRTWNPYV

SEQ ID NO: 500 - protein, 8 aa, Artificial Sequence
  Description of Artificial Sequence: Synthetic peptide
GFTFNDYA

SEQ ID NO: 501 - protein, 8 aa, Artificial Sequence
  Description of Artificial Sequence: Synthetic peptide
ISWSGNNI

SEQ ID NO: 502 - protein, 16 aa, Artificial Sequence
  Description of Artificial Sequence: Synthetic peptide
AKDSIRYGITWGGFDY

SEQ ID NO: 503 - protein, 6 aa, Artificial Sequence
  Description of Artificial Sequence: Synthetic peptide
KLGEKY

SEQ ID NO: 504 - protein, 3 aa, Artificial Sequence
  Description of Artificial Sequence: Synthetic peptide
QDT

SEQ ID NO: 505 - protein, 8 aa, Artificial Sequence
  Description of Artificial Sequence: Synthetic peptide
QAWDRGVV

SEQ ID NO: 506 - protein, 8 aa, Artificial Sequence
  Description of Artificial Sequence: Synthetic peptide
INWDGGST

SEQ ID NO: 507 - protein, 11 aa, Artificial Sequence
  Description of Artificial Sequence: Synthetic peptide
AKGMGLRAFDY

SEQ ID NO: 508 - protein, 8 aa, Artificial Sequence
  Description of Artificial Sequence: Synthetic peptide
SNNVGNLG

SEQ ID NO: 509 - protein, 9 aa, Artificial Sequence
  Description of Artificial Sequence: Synthetic peptide
SAWDSSLSA

SEQ ID NO: 510 - protein, 8 aa, Artificial Sequence
  Description of Artificial Sequence: Synthetic peptide
GYTFSWYA

SEQ ID NO: 511 - protein, 8 aa, Artificial Sequence
  Description of Artificial Sequence: Synthetic peptide
INAGNGNT

SEQ ID NO: 512 - protein, 15 aa, Artificial Sequence
  Description of Artificial Sequence: Synthetic peptide
ARPDNYGSGGDVFDI

SEQ ID NO: 513 - protein, 3 aa, Artificial Sequence
  Description of Artificial Sequence: Synthetic peptide
SND

SEQ ID NO: 514 - protein, 12 aa, Artificial Sequence
  Description of Artificial Sequence: Synthetic peptide
ASWDDSLNGRYV

SEQ ID NO: 515 - protein, 8 aa, Artificial Sequence
  Description of Artificial Sequence: Synthetic peptide
GFTFSSYE

SEQ ID NO: 516 - protein, 8 aa, Artificial Sequence
  Description of Artificial Sequence: Synthetic peptide
ISSSGSTI

SEQ ID NO: 517 - protein, 9 aa, Artificial Sequence
  Description of Artificial Sequence: Synthetic peptide
ARWDYGMDV

SEQ ID NO: 518 - protein, 8 aa, Artificial Sequence
  Description of Artificial Sequence: Synthetic peptide
SGSIASNF

SEQ ID NO: 519 - protein, 9 aa, Artificial Sequence
  Description of Artificial Sequence: Synthetic peptide
QSYDTSNVV

SEQ ID NO: 520 - protein, 8 aa, Artificial Sequence
  Description of Artificial Sequence: Synthetic peptide
GYTFTWYA

SEQ ID NO: 521 - protein, 8 aa, Artificial Sequence
  Description of Artificial Sequence: Synthetic peptide
INAGSGNT

SEQ ID NO: 522 - protein, 15 aa, Artificial Sequence
  Description of Artificial Sequence: Synthetic peptide
ARPNNYGSGGDVFDI

SEQ ID NO: 523 - protein, 3 aa, Artificial Sequence
  Description of Artificial Sequence: Synthetic peptide
SSS

SEQ ID NO: 524 - protein, 9 aa, Artificial Sequence
  Description of Artificial Sequence: Synthetic peptide
ATWDDSLNA

SEQ ID NO: 525 - protein, 8 aa, Artificial Sequence
  Description of Artificial Sequence: Synthetic peptide
GYTFTNYA

SEQ ID NO: 526 - protein, 8 aa, Artificial Sequence
  Description of Artificial Sequence: Synthetic peptide
INGGNGNT

SEQ ID NO: 527 - protein, 14 aa, Artificial Sequence
  Description of Artificial Sequence: Synthetic peptide
AKPEETAGTIHFDY

SEQ ID NO: 528 - protein, 11 aa, Artificial Sequence
  Description of Artificial Sequence: Synthetic peptide
GTWDSSLSAYV

SEQ ID NO: 529 - protein, 19 aa, Artificial Sequence
  Description of Artificial Sequence: Synthetic peptide
AGEGYYDSSGYSNGDAFDI

SEQ ID NO: 530 - protein, 9 aa, Artificial Sequence
  Description of Artificial Sequence: Synthetic peptide
QSYDSTITV

SEQ ID NO: 531 - protein, 9 aa, Artificial Sequence
  Description of Artificial Sequence: Synthetic peptide
QSYDSSNVV

SEQ ID NO: 532 - protein, 16 aa, Artificial Sequence
  Description of Artificial Sequence: Synthetic peptide
AKDRGGGVIVKDAFDI

SEQ ID NO: 533 - protein, 6 aa, Artificial Sequence
  Description of Artificial Sequence: Synthetic peptide
RLTNKY

SEQ ID NO: 534 - protein, 3 aa, Artificial Sequence
  Description of Artificial Sequence: Synthetic peptide
EDA

SEQ ID NO: 535 - protein, 9 aa, Artificial Sequence
  Description of Artificial Sequence: Synthetic peptide
QAWDSSVVV

SEQ ID NO: 536 - protein, 11 aa, Artificial Sequence
  Description of Artificial Sequence: Synthetic peptide
ARQQGGGWYDV

SEQ ID NO: 537 - protein, 8 aa, Artificial Sequence
  Description of Artificial Sequence: Synthetic peptide
GYTFTSYT

SEQ ID NO: 538 - protein, 8 aa, Artificial Sequence
  Description of Artificial Sequence: Synthetic peptide
ISTYNGLT

SEQ ID NO: 539 - protein, 16 aa, Artificial Sequence
  Description of Artificial Sequence: Synthetic peptide
VREGSPDYGDFASFDY

SEQ ID NO: 540 - protein, 8 aa, Artificial Sequence
  Description of Artificial Sequence: Synthetic peptide
NFNVGNND

SEQ ID NO: 541 - protein, 12 aa, Artificial Sequence
  Description of Artificial Sequence: Synthetic peptide
GTWDSSLNTGGV

SEQ ID NO: 542 - protein, 12 aa, Artificial Sequence
  Description of Artificial Sequence: Synthetic peptide
GTWDTSLSGFYV

SEQ ID NO: 543 - protein, 16 aa, Artificial Sequence
  Description of Artificial Sequence: Synthetic peptide
ARDPAYGDYEYDAFDI

SEQ ID NO: 544 - protein, 8 aa, Artificial Sequence
  Description of Artificial Sequence: Synthetic peptide
TSNIGSNT

SEQ ID NO: 545 - protein, 11 aa, Artificial Sequence
  Description of Artificial Sequence: Synthetic peptide
ATWDDSLSGVV

SEQ ID NO: 546 - protein, 11 aa, Artificial Sequence
  Description of Artificial Sequence: Synthetic peptide
ARGAGFDAFDI

SEQ ID NO: 547 - protein, 8 aa, Artificial Sequence
  Description of Artificial Sequence: Synthetic peptide
SSNIGTNG

SEQ ID NO: 548 - protein, 3 aa, Artificial Sequence
  Description of Artificial Sequence: Synthetic peptide
TND

SEQ ID NO: 549 - protein, 11 aa, Artificial Sequence
  Description of Artificial Sequence: Synthetic peptide
AVWDHSLNGPV

SEQ ID NO: 550 - protein, 10 aa, Artificial Sequence
  Description of Artificial Sequence: Synthetic peptide
AREGLDAFDI

SEQ ID NO: 551 - protein, 8 aa, Artificial Sequence
  Description of Artificial Sequence: Synthetic peptide
GYSFTSYT

SEQ ID NO: 552 - protein, 8 aa, Artificial Sequence
  Description of Artificial Sequence: Synthetic peptide
VSTYNGLR

SEQ ID NO: 553 - protein, 16 aa, Artificial Sequence
  Description of Artificial Sequence: Synthetic peptide
VREGSPDYGDFAAFDY

SEQ ID NO: 554 - protein, 12 aa, Artificial Sequence
  Description of Artificial Sequence: Synthetic peptide
GTWDSSLSAAYV

SEQ ID NO: 555 - protein, 10 aa, Artificial Sequence
  Description of Artificial Sequence: Synthetic peptide
ARDGGGYFDY

SEQ ID NO: 556 - protein, 8 aa, Artificial Sequence
  Description of Artificial Sequence: Synthetic peptide
RSNIGTNI

SEQ ID NO: 557 - protein, 2 aa, Artificial Sequence
  Description of Artificial Sequence: Synthetic peptide
GS

SEQ ID NO: 558 - protein, 11 aa, Artificial Sequence
  Description of Artificial Sequence: Synthetic peptide
AAWDDSLNGPA

SEQ ID NO: 559 - protein, 8 aa, Artificial Sequence
  Description of Artificial Sequence: Synthetic peptide
GYNFISYY

SEQ ID NO: 560 - protein, 8 aa, Artificial Sequence
  Description of Artificial Sequence: Synthetic peptide
INPGSGET

SEQ ID NO: 561 - protein, 14 aa, Artificial Sequence
  Description of Artificial Sequence: Synthetic peptide
ATGLIRGASDAFNI

SEQ ID NO: 562 - protein, 9 aa, Artificial Sequence
  Description of Artificial Sequence: Synthetic peptide
SSNIGARYD

SEQ ID NO: 563 - protein, 3 aa, Artificial Sequence
  Description of Artificial Sequence: Synthetic peptide
ANY

SEQ ID NO: 564 - protein, 11 aa, Artificial Sequence
  Description of Artificial Sequence: Synthetic peptide
QSYDSSVSAWV

SEQ ID NO: 565 - protein, 10 aa, Artificial Sequence
  Description of Artificial Sequence: Synthetic peptide
GDSVSSNSAA

SEQ ID NO: 566 - protein, 9 aa, Artificial Sequence
  Description of Artificial Sequence: Synthetic peptide
TYYRSKWYN

SEQ ID NO: 567 - protein, 12 aa, Artificial Sequence
  Description of Artificial Sequence: Synthetic peptide
ARERSGWKGFDY

SEQ ID NO: 568 - protein, 6 aa, Artificial Sequence
  Description of Artificial Sequence: Synthetic peptide
KLGDKF

SEQ ID NO: 569 - protein, 9 aa, Artificial Sequence
  Description of Artificial Sequence: Synthetic peptide
QTWASGIVV

SEQ ID NO: 570 - protein, 12 aa, Artificial Sequence
  Description of Artificial Sequence: Synthetic peptide
AKWGPFQDAFDI

SEQ ID NO: 571 - protein, 11 aa, Artificial Sequence
  Description of Artificial Sequence: Synthetic peptide
QSLLERNAYNY

SEQ ID NO: 572 - protein, 3 aa, Artificial Sequence
  Description of Artificial Sequence: Synthetic peptide
LGS

SEQ ID NO: 573 - protein, 9 aa, Artificial Sequence
  Description of Artificial Sequence: Synthetic peptide
MQALQAPFT

SEQ ID NO: 574 - protein, 16 aa, Artificial Sequence
  Description of Artificial Sequence: Synthetic peptide
AKARWTAVASDHHFDY

SEQ ID NO: 575 - protein, 3 aa, Artificial Sequence
  Description of Artificial Sequence: Synthetic peptide
EVS

SEQ ID NO: 576 - protein, 11 aa, Artificial Sequence
  Description of Artificial Sequence: Synthetic peptide
SSYTSSSTPYV

SEQ ID NO: 577 - protein, 9 aa, Artificial Sequence
  Description of Artificial Sequence: Synthetic peptide
ARDWDYMDV

SEQ ID NO: 578 - protein, 20 aa, Artificial Sequence
  Description of Artificial Sequence: Synthetic peptide
ARDLSRGANPHYYYYYGMDV

SEQ ID NO: 579 - protein, 18 aa, Artificial Sequence
  Description of Artificial Sequence: Synthetic peptide
ATESNLVSRHYYYYGMDV

SEQ ID NO: 580 - protein, 9 aa, Artificial Sequence
  Description of Artificial Sequence: Synthetic peptide
RSNIGAGYD

SEQ ID NO: 581 - protein, 13 aa, Artificial Sequence
  Description of Artificial Sequence: Synthetic peptide
QSYDNTVRESPYV

SEQ ID NO: 582 - protein, 8 aa, Artificial Sequence
  Description of Artificial Sequence: Synthetic peptide
GYTFTGYY

SEQ ID NO: 583 - protein, 8 aa, Artificial Sequence
  Description of Artificial Sequence: Synthetic peptide
INPNSGGT

SEQ ID NO: 584 - protein, 25 aa, Artificial Sequence
  Description of Artificial Sequence: Synthetic peptide
ARDYGYYGSGSYSSGPLYYYYGMDV

SEQ ID NO: 585 - protein, 8 aa, Artificial Sequence
  Description of Artificial Sequence: Synthetic peptide
SSNIGSNS

SEQ ID NO: 586 - protein, 3 aa, Artificial Sequence
  Description of Artificial Sequence: Synthetic peptide
NND

SEQ ID NO: 587 - protein, 16 aa, Artificial Sequence
  Description of Artificial Sequence: Synthetic peptide
AKDITYGSGSYGAFDI

SEQ ID NO: 588 - protein, 6 aa, Artificial Sequence
  Description of Artificial Sequence: Synthetic peptide
DIGSKS

SEQ ID NO: 589 - protein, 8 aa, Artificial Sequence
  Description of Artificial Sequence: Synthetic peptide
GGTFSSNS

SEQ ID NO: 590 - protein, 8 aa, Artificial Sequence
  Description of Artificial Sequence: Synthetic peptide
IFPILGIT

SEQ ID NO: 591 - protein, 13 aa, Artificial Sequence
  Description of Artificial Sequence: Synthetic peptide
ARGNYQWYDAFDI

SEQ ID NO: 592 - protein, 9 aa, Artificial Sequence
  Description of Artificial Sequence: Synthetic peptide
QSYDSTSVL

SEQ ID NO: 593 - DNA, 822 bp, Artificial Sequence
  Description of Artificial Sequence: Synthetic polynucleotide
cagtctgtgttgacgcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtgtatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcgaaggtccgtacgacggtttcgattcttggggtcaaggtactctggtgaccgtctcctcaactagtggccaggccggccagcaccatcaccatcaccatggcgcatacccgtacgacgttccggactacgcttct

SEQ ID NO: 594 - protein, 274 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSSTSGQAGQHHHHHHGAYPYDVPDYAS

SEQ ID NO: 595 - DNA, 822 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattctgtggtattcggcggagggaccaagctgaccgtcctaggttctagaggtggtggtggtagcggcggcggcggctctggtggtggtggatccctcgagatggcccaggtccagctggtacagtctggcactgaggtgaagaagcctggggcctcagtgagggtcgcctgcaaggcttctggttacccctttaacaaatatgacatcaactgggtgcgacaggcccctggacaagggcttgagtggatgggaggcatcatccctatctttcgtacaacaaactacgcacagaagttccagggcagagtcacgattaccgcggacgaatccacgagcacagcctacatggagctgagcagcctgagatctgaggacacggccgtatattactgtgcgcgcgaatggttctactgggatatctggggtcaaggtactctggtgaccgtctcctcaactagtggccaggccggccagcaccatcaccatcaccatggcgcatacccgtacgacgttccggactacgcttct

SEQ ID NO: 596 - protein, 274 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSSTSGQAGQHHHHHHGAYPYDVPDYAS

SEQ ID NO: 597 - DNA, 825 bp, Artificial Sequence
  Description of Artificial Sequence: Synthetic polynucleotide
cagtctgtgttgactcagccaccctcagtgtccgtgtccccaggacagacagccagcatctcctgctctggaaataaattggggactaagtatgtttactggtatcagaagaggccaggccagtcccctgtgttggtcatgtatgaagataatcagcggccctcagggatcccggagcggttctctggctccaactctgggaacacagccactctgaccatcagagggacccagactgtggatgaggctgactattactgtcaggcgtgggactccgacactttcgtggtcttcggcggagggaccaaggtcaccgtcctaggttctagaggtggtggtggtagcggcggcggcggctctggtggtggtggatccctcgagatggccgaggtgcagctggtggagaccgggggaggcgtggtccagcctgggaggtccctgagactctcctgtgcagcctctggattcaccttcagtagttatggcatgcactgggtccgccaggctccaggcaaggggctggagtgggtggcagttatatcacatgatggaagtaataaatactacgcagactccgtgaagggccgattcaccatctccagagacaattccaaggacacgctgtatctgcaaatgaacagcctgagaggtgaggacacggccgtatattactgtgcgcgctctaaccagtggtctggttacttctctttcgattactggggtcaaggtactctggtgaccgtctcctcaactagtggccaggccggccagcaccatcaccatcaccatggcgcatacccgtacgacgttccggactacgcttct

SEQ ID NO: 598 - protein, 275 aa, Artificial Sequence
  Description of Artificial Sequence: Synthetic polypeptide
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSSTSGQAGQHHHHHHGAYPYDVPDYAS

SEQ ID NO: 599 - DNA, 819 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtggtggtcatccattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggccgaggtgcagctggtgcagtctggagctgaggtgaagaagcctggggcctcagtgaaggtctcctgcaaggcttctggttacacctttaccacctatggtatcagctgggtgcgacaggcccctggacaagggcttgagtggatgggatggatcaacacttacaatggtcacacaaactatgcacagaagctccagggcagagccacaatgaccgcagacacatccacgaacacagcctacatggagctgaggagcctgagatctgacgacactgccgtgtattactgtgcgcgcgttatctacggttctggtgattactggggtcaaggtactctggtgaccgtctcctcaactagtggccaggccggccagcaccatcaccatcaccatggcgcatacccgtacgacgttccggactacgcttct

SEQ ID NO: 600 - protein, 273 aa, Artificial Sequence
  Description of Artificial Sequence: Synthetic polypeptide
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSSTSGQAGQHHHHHHGAYPYDVPDYAS

SEQ ID NO: 601 - DNA, 813 bp, Artificial Sequence
  Description of Artificial Sequence: Synthetic polynucleotide
tcctatgtgctgactcagccactctcagtgtcagtggccccaggaaagacggccaggattacctgtgggggaaacaacattggaagtaaaactgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatcgggtgttcggcggagggaccaagctgaccgtcctaggttctagaggtggtggtggtagcggcggcggcggctctggtggtggtggatccctcgagatggcccaggtgcagctgcaggagtcgggcccaggactggtgaagccttcggagaccctgtccctcacctgcaatgtctctggttactccatcagcagtggttacttttggggctggatccggcagcccccagggaaggggctggagtggattgggagtatctatcatagtaggagcacctactacaacccgtccctcaagagtcgagtcaccatatcagtagacacgtccaagaaccagttctccctgaagctgaactctgtgaccgccgcagacacggccgtgtattactgtgcgcgcggttacggttacttcgattactggggtcaaggtactctggtgaccgtctcctcaactagtggccaggccggccagcaccatcaccatcaccatggcgcatacccgtacgacgttccggactacgcttct

SEQ ID NO: 602 - protein, 271 aa, Artificial Sequence
  Description of Artificial Sequence: Synthetic polypeptide
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSSTSGQAGQHHHHHHGAYPYDVPDYAS

SEQ ID NO: 603 - DNA, 834 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttcgaaggtgttcggcggagggaccaagctgaccgtcctaggttctagaggtggtggtggtagcggcggcggcggctctggtggtggtggatccctcgagatggccgaggtgcagctggtggagtctgggggaggtgtggtacggcctggggggtccctgagactctcctgtgcagcctctggattcacctttggtgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtatattactgtgcgcgctctaaatacaacttccatgtttactacgattactggggtcaaggtactctggtgaccgtctcctcaactagtggccaggccggccagcaccatcaccatcaccatggcgcatacccgtacgacgttccggactacgcttct

SEQ ID NO: 604 - protein, 278 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSSTSGQAGQHHHHHHGAYPYDVPDYAS

SEQ ID NO: 605 - DNA, 831 bp, Artificial Sequence
  Description of Artificial Sequence: Synthetic polynucleotide
cagtctgtgttgacgcagccaccctcagcgtctgggacccccgggcagacagtcaccatctcttgttctggaagcaactccaacatcggaagtaattatgtatactggtaccagcagctcccaggaacggcccccaaactcctcatctataggaataatcagcggccctcaggggtccctgaccgattctcaggctccaagtctggcacctcagcctccctggccatcagtgggctccgctccgaggatgaggctgattattactgtgcagcatgggatgacagcctgagtgcttatgtcttcggaactgggaccaaggtcaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctcttctggtaacatggtttcttggaaagatatgtggggtcaaggtactctggtgaccgtctcctcaactagtggccaggccggccagcaccatcaccatcaccatggcgcatacccgtacgacgttccggactacgcttct

SEQ ID NO: 606 - protein, 277 aa, Artificial Sequence
  Description of Artificial Sequence: Synthetic polypeptide
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSSTSGQAGQHHHHHHGAYPYDVPDYAS

SEQ ID NO: 607 - DNA, 822 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactctgtctcctggtaccaacaacacccaggcaaagcccccagactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacccctttagtcttcggaactgggaccaaggtcaccgtcctaggttctagaggtggtggtggtagcggcggcggcggctctggtggtggtggatccctcgagatggcccaggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgctgttgcttaccatgattggggtcaaggtactctggtgaccgtctcctcaactagtggccaggccggccagcaccatcaccatcaccatggcgcatacccgtacgacgttccggactacgcttct

SEQ ID NO: 608 - protein, 274 aa, Artificial Sequence
  Description of Artificial Sequence: Synthetic polypeptide
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSSTSGQAGQHHHHHHGAYPYDVPDYAS

SEQ ID NO: 609 - DNA, 825 bp, Artificial Sequence
  Description of Artificial Sequence: Synthetic polynucleotide
cagtctgtcgtgacgcagccgccctcagtgtctgcggccccaggacagagggtcaccatctcctgctctggaagcagctccaacatttcgatttatgatgtatcctggtatcagcagctcccaggaacagcccccaaactcctcatttatggcaataataagcgaccctcggggattgctgaccgattctctggctccacgtctggcacgtcagccaccctgggcatcaccggactccagactggggacgaggccgattattactgcggaacatgggatgacagtctgagtgggggggtgttcggcggagggaccaagctgaccgtcctaggttctagaggtggtggtggtagcggcggcggcggctctggtggtggtggatccctcgagatggcccagatgcagctggtgcaatctggggctgaggtgaagaagcctgggtcctcggtgaaggtctcctgcgaggcttctggaggcaccctcagcagctatgctatcaactgggtgcgacaggcccctggacaagggcttgagtggatgggagggatcatccctatgtttggtacagcacactacgcacagaagttccagggcagagtcacgattaccgcggacgaatccacgaaaacagcctacatggagctgagcagcctgagatctgaggacactgccgtgtattactgtgcgcgcggtgttcattacgcttctttcgatcattggggtcaaggtactctggtgaccgtctcctcaactagtggccaggccggccagcaccatcaccatcaccatggcgcatacccgtacgacgttccggactacgcttct

SEQ ID NO: 610 - protein, 275 aa, Artificial Sequence
  Description of Artificial Sequence: Synthetic polypeptide
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSSTSGQAGQHHHHHHGAYPYDVPDYAS

SEQ ID NO: 611 - DNA, 822 bp, Artificial Sequence
  Description of Artificial Sequence: Synthetic polynucleotide
cagtctgtgttgacgcagccgccctcagtgtctgcggccgcaggacagaaggtcaccatctcctgctctggaagcgactccaacattgggaataattatgtgtcctggtatcaacacctcccagggacagcccccaaactcctcatttatgacgttaaaaatcgaccctcagggattcctgaccggttctccggctccaagtctggctcgtcagccaccctaggcatcgccggactccagcctggggacgaggccgattattactgcggaacatgggacagtcggctggatgcctatgtcttcggaactgggaccaaggtcaccgtcctaggttctagaggtggtggtggtagcggcggcggcggctctggtggtggtggatccctcgagatggcccagatgcagctggtgcaatctggagctgaggtgaagaagcctggggcctcagtgaaggtctcctgcaagacttctggtttcccctttaatatctttggaatcacctgggtgcgacaggcccctggacaagggcttgagtggatgggatggatcagcggttacaacggtaacacagactacccacagaagttccagggcagagtcaccatgtccacagacacatccacgagtacagcctacatggagctgaggaacctgaaatctgacgacacggccgtgtattactgtgcgcgcggtgcttacggtggtatggatacttggggtcaaggtactctggtgaccgtctcctcaactagtggccaggccggccagcaccatcaccatcaccatggcgcatacccgtacgacgttccggactacgcttct

SEQ ID NO: 612 - protein, 274 aa, Artificial Sequence
  Description of Artificial Sequence: Synthetic polypeptide
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSSTSGQAGQHHHHHHGAYPYDVPDYAS

SEQ ID NO: 613 - DNA, 828 bp, Artificial Sequence
  Description of Artificial Sequence: Synthetic polynucleotide
cagtctgtcgtgacgcagccgccctcagtgtctggggccccagggcagagggtcaccatctcctgcactgggagcacctccaacatcggggcaggttatgatgtacactggtatcagcagcttccaggaacagcccccaaactcctcatctatactaacaactttcggccctcaggggtccctgaccgattctctgcctccaagtctggcacttcagcttccctggccatcactggtctccaggctgaggatgaggctgattattactgcggaacatgggatagcagcctgagtgccgttgtgttcggcggagggaccaagctgaccgtcctaggttctagaggtggtggtggtagcggcggcggcggctctggtggtggtggatccctcgagatggccgaggtgcagctggtggagtctggaactgaggtgaagaagcctggggcctcagtgaaagtctcctgcaaggcttctggttacatgtttaccagttatggtctcaactgggtgcgacaggcccctggacaagggcttgagtggatgggatggatcagcgctaacaatggtaagacaaattatgctaagaaattccaggacagagtcaccatgaccagagacacttccacgagcacaggctacatggaactgaggagcctgagatctgacgacacggccgtatattactgtgcgcgccatatcggtggttcttacttcgatcgttggggtcaaggtactctggtgaccgtctcctcaactagtggccaggccggccagcaccatcaccatcaccatggcgcatacccgtacgacgttccggactacgcttct

SEQ ID NO: 614 - protein, 276 aa, Artificial Sequence
  Description of Artificial Sequence: Synthetic polypeptide
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSSTSGQAGQHHHHHHGAYPYDVPDYAS

SEQ ID NO: 615 - DNA, 822 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggttctagaggtggtggtggtagcggcggcggcggctctggtggtggtggatccctcgagatggccgaggtgcagctggtggagactgggggaggcttggtacagcctggggggtccctgagactctcctgtgcagcctctggattcacctttagcagctatgccatgagctgggtccgccaggctccagggaaggggctggagtgggtctcagctattagtggtagtgatggtagcacatactacgcagactccgtgaagggccggttcaccatctccagagacaattccaagaacacgctgtatctgcaaatgaacagcctgagagacgaggacacggccgtatattactgtgcgcgctctcatgaagctaacctggttggtgattggtggggtcaaggtactctggtgaccgtctcctcaactagtggccaggccggccagcaccatcaccatcaccatggcgcatacccgtacgacgttccggactacgcttct

SEQ ID NO: 616 - protein, 274 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSSTSGQAGQHHHHHHGAYPYDVPDYAS

SEQ ID NO: 617 - DNA, 816 bp, Artificial Sequence
  Description of Artificial Sequence: Synthetic polynucleotide
cagtctgtggtgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatgtggtattcggcggagggaccaagctgaccgtcctaggttctagaggtggtggtggtagcggcggcggcggctctggtggtggtggatccctcgagatggccgaggtccagctggtacagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgctggggtggtttcggtgctgttgatcattggggtcaaggtactctggtgaccgtctcctcaactagtggccaggccggccagcaccatcaccatcaccatggcgcatacccgtacgacgttccggactacgcttct

SEQ ID NO: 618 - protein, 272 aa, Artificial Sequence
  Description of Artificial Sequence: Synthetic polypeptide
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSSTSGQAGQHHHHHHGAYPYDVPDYAS

SEQ ID NO: 619 - DNA, 810 bp, Artificial Sequence
  Description of Artificial Sequence: Synthetic polynucleotide
tcttctgagctgactcaggaccctgctgtgtctgtggccttgggacagacagtcaagatcacgtgccaaggagacagcctcacagactaccatgcaacctggtaccagcagaagccaggacaggcccctgtcgctgtcatctatgctacaaacaaccggcccactgggatcccagaccgattctctggttccagttccggaaacacagcttctttgaccatcactggggctcaggcggaagatgaggctgactattactgtaattcccgggacagcggcacggacgaagtgttattcggcggagggaccaagctgaccgtcctaggttctagaggtggtggtggtagcggcggcggcggctctggtggtggtggatccctcgagatggccgaggtgcagctggtggagactgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcgcgcggtcagggttacgattactggggtcaaggtactctggtgaccgtctcctcaactagtggccaggccggccagcaccatcaccatcaccatggcgcatacccgtacgacgttccggactacgcttct

SEQ ID NO: 620 - protein, 270 aa, Artificial Sequence
  Description of Artificial Sequence: Synthetic polypeptide
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSSTSGQAGQHHHHHHGAYPYDVPDYAS

SEQ ID NO: 621 - DNA, 810 bp, Artificial Sequence
  Description of Artificial Sequence: Synthetic polynucleotide
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgagcatcagcagggtcgaagccggggatgaggccgactattactgtcaggtgtgggatagtagtagtgatcatactgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgctactacccgggtatggatatgtggggtcaaggtactctggtgaccgtctcctcaactagtggccaggccggccagcaccatcaccatcaccatggcgcatacccgtacgacgttccggactacgcttct

SEQ ID NO: 622 - protein, 270 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSSTSGQAGQHHHHHHGAYPYDVPDYAS

SEQ ID NO: 623 - DNA, 816 bp, Artificial Sequence
  Description of Artificial Sequence: Synthetic polynucleotide
caggctgtgctgactcagccgccctcaacgtctgggacccccgggcagagggtcaccatctcttgttctggaagcagctccaacatcgggagaaatggtgtaaactggtaccagcagctcccaggagcggcccccaaagtcctcatctataatgataatcagcgaccctcaggggtccctgaccgagtctctggctcccagtctggctcctcaggcaccctggccatcgatgggcttcggtctgaggatgaggctgattattactgtgcggcatgggatgacagcctgcatggtgtggtattcggcggagggaccaagctgaccgtcctaggttctagaggtggtggtggtagcggcggcggcggctctggtggtggtggatccctcgagatggcccaggtccagctggtacagtctggggctgaggtgaagaagcctggggcctcagtgaaggtctcctgcaaggtttccggatacaccctcaatgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcggtggttacggtgattcttggggtcaaggtactctggtgaccgtctcctcaactagtggccaggccggccagcaccatcaccatcaccatggcgcatacccgtacgacgttccggactacgcttct

SEQ ID NO: 624 - protein, 272 aa, Artificial Sequence
  Description of Artificial Sequence: Synthetic polypeptide
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSSTSGQAGQHHHHHHGAYPYDVPDYAS

SEQ ID NO: 625 - DNA, 870 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattcttgggtgttcggcggagggaccaagctgaccgtcctaggttctagaggtggtggtggtagcggcggcggcggctctggtggtggtggatccctcgagatggcccaggtgcagctggtgcaatctggggctgaggtgaagaggcctgggtcctcggtgaaggtctcctgcacggcttctggaggcaccttcagcagcgatgctatcagctgggtgcgacaggcccctggacaagggcttgagtggatgggaggaatcatccctatgtttggtacagcaaactacgcacagaagttccagggcagagtcacgattaccgcggacgaatccacgagcacagcctacatggagctgagcagcctgagatctgaggacacggccgtgtattactgtgcgcgcgaaggttactactacccgtctgcttacctgggttctgttctgaacgacatctcttctgtttacgatgaatggggtcaaggtactctggtgaccgtctcctcaactagtggccaggccggccagcaccatcaccatcaccatggcgcatacccgtacgacgttccggactacgcttct

SEQ ID NO: 626 - protein, 290 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSSTSGQAGQHHHHHHGAYPYDVPDYAS

SEQ ID NO: 627 - DNA, 822 bp, Artificial Sequence
  Description of Artificial Sequence: Synthetic polynucleotide
cagtctgtcgtgacgcagccgccctcagtgtctgcggccccaggacagaaggtcaccatctcctgctctggaagcacctccaacattggaaataatgatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcgtgagtgcttcttgggtcttcggcagagggaccaagctgaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatccacagaagctccagggcagagtcaccatgaccacagacccatccacgagcacagcctacatggagctgaggagcctgagatctgacgacacggccgtgtattactgtgcgcgctctatgacttctttcgattactggggtcaaggtactctggtgaccgtctcctcaactagtggccaggccggccagcaccatcaccatcaccatggcgcatacccgtacgacgttccggactacgcttct

SEQ ID NO: 628 - protein, 274 aa, Artificial Sequence
  Description of Artificial Sequence: Synthetic polypeptide
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSSTSGQAGQHHHHHHGAYPYDVPDYAS

SEQ ID NO: 629 - DNA, 822 bp, Artificial Sequence
  Description of Artificial Sequence: Synthetic polynucleotide
cagtctgtgttgacgcagccgccctcagtgtctgcggccccaggacagaaggtcaccatctcctgctctggaagcaactccaacattgggaataattatgtatcctggtatcagcaactcccagggacagcccccaaactcctcatttatgacaataataagcgaccctcagggattcctgaccgattctctggctccaggtctggcacgtcagccaccctgggcatcaccggactccagactggggacgaggccgattattactgcggaacatggaataccactgtgactcctggctatgtcttcggaactgggaccaaggtcaccgtcctaggttctagaggtggtggtggtagcggcggcggcggctctggtggtggtggatccctcgagatggccgaagtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacaccgccatgtattactgtgcgcgctctgtttacgacctggatacttggggtcaaggtactctggtgaccgtctcctcaactagtggccaggccggccagcaccatcaccatcaccatggcgcatacccgtacgacgttccggactacgcttct

SEQ ID NO: 630 - protein, 274 aa, Artificial Sequence
  Description of Artificial Sequence: Synthetic polypeptide
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSSTSGQAGQHHHHHHGAYPYDVPDYAS

SEQ ID NO: 631 - DNA, 831 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgggggccccttatgtcttcggaactgggaccaaggtcaccgtcctaggttctagaggtggtggtggtagcggcggcggcggctctggtggtggtggatccctcgagatggccgaggtgcagctggtgcagtcttggggaggctcggaacagcctggcaggtccctgagactctcctgtgcagcctctggattcacctttgatgattatgccatgcactgggtccggcaagctccagggaagggcctggagtgggtctcaggtattagttggaatagcggtagcataggctatgcggactctgtgaagggccgattcaccatctccagagacaacgccaagaattccctgtatctgcaaatgaacagtctgagagctgaggacaccgccatgtattactgtgcgcgctaccgtcaggttggttctgcttacgattcttggggtcaaggtactctggtgaccgtctcctcaactagtggccaggccggccagcaccatcaccatcaccatggcgcatacccgtacgacgttccggactacgcttct

SEQ ID NO: 632 - protein, 277 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSSTSGQAGQHHHHHHGAYPYDVPDYAS

SEQ ID NO: 633 - DNA, 822 bp, Artificial Sequence
  Description of Artificial Sequence: Synthetic polynucleotide
ctgcctgtgctgactcagccaccctcggtgtcagtggccccaggaaagacggccaggattacctgtgggggaaacaacattggaagtaaaagtgtgcactggtatcagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggatagtagtagttatcataattatgtcttcggaactgggaccaaggtcaccgtcctaggttctagaggtggtggtggtagcggcggcggcggctctggtggtggtggatccctcgagatggccgaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacaccgccatgtattactgtgcgcgctactggggtttcggtgtttctgatcgttggggtcaaggtactctggtgaccgtctcctcaactagtggccaggccggccagcaccatcaccatcaccatggcgcatacccgtacgacgttccggactacgcttct

SEQ ID NO: 634 - protein, 274 aa, Artificial Sequence
  Description of Artificial Sequence: Synthetic polypeptide
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSSTSGQAGQHHHHHHGAYPYDVPDYAS

SEQ ID NO: 635 - DNA, 825 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccccgatcggttctctggctccatcgacagctcctccaactctgcctccctcaccatctctggactgaagactgaggacgaggctgactactactgtcagtcttatgacagcagcaatctttgggtgttcggcggagggaccaagctgaccgtcctaggttctagaggtggtggtggtagcggcggcggcggctctggtggtggtggatccctcgagatggcccagatgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactactactacgattcttggggtcaaggtactctggtgaccgtctcctcaactagtggccaggccggccagcaccatcaccatcaccatggcgcatacccgtacgacgttccggactacgcttct

SEQ ID NO: 636 - protein, 275 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSSTSGQAGQHHHHHHGAYPYDVPDYAS

SEQ ID NO: 637 - DNA, 816 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaacgttctagaggtggtggtggtagcggcggcggcggctctggtggtggtggatccctcgagatggccgaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacaccgccatgtattactgtgcgcgctactggggttacgactcttacgatgaatggggtcaaggtactctggtgaccgtctcctcaactagtggccaggccggccagcaccatcaccatcaccatggcgcatacccgtacgacgttccggactacgcttct

SEQ ID NO: 638 - protein, 272 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSSTSGQAGQHHHHHHGAYPYDVPDYAS

SEQ ID NO: 639 - DNA, 822 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcaacaaccattactacaacgattactggggtcaaggtactctggtgaccgtctcctcaactagtggccaggccggccagcaccatcaccatcaccatggcgcatacccgtacgacgttccggactacgcttct

SEQ ID NO: 640 - protein, 274 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSSTSGQAGQHHHHHHGAYPYDVPDYAS

SEQ ID NO: 641 - DNA, 852 bp, Artificial Sequence
  Description of Artificial Sequence: Synthetic polynucleotide
cagtctgtgttgacgcagccgccctcagtgtctggggccccagggcagggggtcaccatcccctgcactgggagcagctccaacatcggggcaggttatgatgtacactggtaccagcagcttccagggacagcccccaaactcctcatctatggtaacaacaatcggccctcaggggtccctgaccgcttctctggctccaggtctggctcctcagcctccctggccatcactgggctccaggctgaggatgaggctgattattactgccagtcctatgacagcagcctgagtgatgtggtattcggcggagggaccaaggtcaccgtcctaggttctagaggtggtggtggtagcggcggcggcggctctggtggtggtggatccctcgagatggccgaggtccagctggtgcagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcgcgctactggtcttactctttcgactacctgtacatgccggaaggtaacgattggtggggtcaaggtactctggtgaccgtctcctcaactagtggccaggccggccagcaccatcaccatcaccatggcgcatacccgtacgacgttccggactacgcttct

SEQ ID NO: 642 - protein, 284 aa, Artificial Sequence
  Description of Artificial Sequence: Synthetic polypeptide
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSSTSGQAGQHHHHHHGAYPYDVPDYAS

SEQ ID NO: 643 - DNA, 828 bp, Artificial Sequence
  Description of Artificial Sequence: Synthetic polynucleotide
cagtctgtgttgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggcccaggtccagctggtacagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgcgacctgtactactacgaaggtgttgattactggggtcaaggtactctggtgaccgtctcctcaactagtggccaggccggccagcaccatcaccatcaccatggcgcatacccgtacgacgttccggactacgcttct

SEQ ID NO: 644 - protein, 276 aa, Artificial Sequence
  Description of Artificial Sequence: Synthetic polypeptide
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSSTSGQAGQHHHHHHGAYPYDVPDYAS

SEQ ID NO: 645 - DNA, 822 bp, Artificial Sequence
  Description of Artificial Sequence: Synthetic polynucleotide
caggctgtgctgactcagccaccctcagtgtcagtggccccaggaaagacggccagggttacctgtgggggaaacaacattggaagtgaaagtgtgcactggtaccagcagaagccaggccaggcccctgtgttggtcatctattatgataccgaccggccctcagggatccctgagcgattctctggctcccactctgggaccacggccaccctgaccatcagcagggtcgaagccggggatgaggccgactattactgtcaggtgtgggatagtagtagggatcatgtggtattcggcggagggaccaagctgaccgtcctaggttctagaggtggtggtggtagcggcggcggcggctctggtggtggtggatccctcgagatggcccaggtgcagctggtgcagtctgggggaggcgtggtccagcctgggaggtccctgagactctcctgtgcggcctctggattcaccttcagtagctatgctatgcactgggtccgccaggctccaggcaagggactggagtgggtggcagttatatcatatgatggaagcaataaatactacgcagactccgtgaagggcctattcaccatctccagagacaattccaagaacacgctgtatctgcaaatgaacagcctgagagctgaggacacggccgtgtattactgtgcgcgctcttacttcacttctggtttctacgattactggggtcaaggtactctggtgaccgtctcctcaactagtggccaggccggccagcaccatcaccatcaccatggcgcatacccgtacgacgttccggactacgcttct

SEQ ID NO: 646 - protein, 274 aa, Artificial Sequence
  Description of Artificial Sequence: Synthetic polypeptide
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSSTSGQAGQHHHHHHGAYPYDVPDYAS

SEQ ID NO: 647 - DNA, 825 bp, Artificial Sequence
  Description of Artificial Sequence: Synthetic polynucleotide
cagtctgtcgtgacgcagccgccctcagtgtctggggccccagggcagagggtcaccatctcctgcactgggagcagttccaacatcggggcaggttatgatgtaaattggtatcagcagtttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggttctagaggtggtggtggtagcggcggcggcggctctggtggtggtggatccctcgagatggcccagatgcagctggtgcagtctggggctgaggtgaagaagcctggggcctcagtgaaggtctcctgcaaggcttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcatgtcttctatgtactacgattggggtcaaggtactctggtgaccgtctcctcaactagtggccaggccggccagcaccatcaccatcaccatggcgcatacccgtacgacgttccggactacgcttct

SEQ ID NO: 648 - protein, 275 aa, Artificial Sequence
  Description of Artificial Sequence: Synthetic polypeptide
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSSTSGQAGQHHHHHHGAYPYDVPDYAS

SEQ ID NO: 649 - DNA, 807 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgattatgtcttcggaactgggaccaaggtcaccgtcctaggttctagaggtggtggtggtagcggcggcggcggctctggtggtggtggatccctcgagatggccgaggtgcagctggtggagactgggggaggcttggtcaagcctggagggtccctgagactctcctgtgcagcctctggattcaccgtcagtgactactacatgagctggatccgccaggctccagggaagggcctggagtggatttcatacattagtggtagtggtaatagcatatactacgcagactctgtgaagggccgattcaccatctccagggacaacgccaagaactcactggatctgcaaatgaccagcctgagagccgaggacacggccgtatattactgtgcgcgctctactaaattcgattactggggtcaaggtactctggtgaccgtctcctcaactagtggccaggccggccagcaccatcaccatcaccatggcgcatacccgtacgacgttccggactacgcttct

SEQ ID NO: 650 - protein, 269 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSSTSGQAGQHHHHHHGAYPYDVPDYAS

SEQ ID NO: 651 - DNA, 828 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacgtcggaagttacactgtaaactggtaccggcaactcccaggaacggcccccacactcctcatctataataataatcagcggccctcaggggtccctgaccgattctctgactccaagtctggcacctcggcctccctgaccattagtgggctccagcctgaggatgaggctgattattattgtgcagcatgggatgacaggctgggtggttatgtcttcggaactgggaccaaggtcaccgtcctaggttctagaggtggtggtggtagcggcggcggcggctctggtggtggtggatccctcgagatggccgaggtgcagctggtgcagtctggagcagaggtgaaaaagccgggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctacagtggagcagcctgaaggcctcggacaccgccatgtattactgtgcgcgctctactggttcttctcatatgtctgatgaatggggtcaaggtactctggtgaccgtctcctcaactagtggccaggccggccagcaccatcaccatcaccatggcgcatacccgtacgacgttccggactacgcttct

SEQ ID NO: 652 - protein, 276 aa, Artificial Sequence
  Description of Artificial Sequence: Synthetic polypeptide
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSSTSGQAGQHHHHHHGAYPYDVPDYAS

SEQ ID NO: 653 - DNA, 819 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcattgggtgttcggcggagggaccaagctgaccgtcctaggttctagaggtggtggtggtagcggcggcggcggctctggtggtggtggatccctcgagatggcccaagtgcagctacagcagtggggcgcaggactgttgaagccttcggagaccctgtccctcacctgcgctgtctatggtgggtccttcagtggttactactggagctggatccgccagcccccagggaaggggctggagtggattggggagatcactcatagtggaaggtccaactacaacccgtccctcaagagtcgagtcaccatatcagtagacacgtccaagaaccagttctccctgaagctgagctctgtgaccgccgcggacacggccgtgtattactgtgcgcgctcttctatcatgtctgattactggggtcaaggtactctggtgaccgtctcctcaactagtggccaggccggccagcaccatcaccatcaccatggcgcatacccgtacgacgttccggactacgcttct

SEQ ID NO: 654 - protein, 273 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSSTSGQAGQHHHHHHGAYPYDVPDYAS

SEQ ID NO: 655 - DNA, 828 bp, Artificial Sequence
  Description of Artificial Sequence: Synthetic polynucleotide
cagtctgtgttgacgcagccgccctcagtgtctggggccccagggcagagggtcaccatctcctgcactgggagcacctccaacatcggggcaggttatgatgtacactggtaccagcagcttccaggaacagcccccaaactcctcatcaacaataacaggaatcggccctcaggggtccctgaccgattctctggctccaagtctggcacgtcagccaccctgggcatcaccggactccagactggggacgaggccgattattactgcggaacatgggatggcagcctgactggtgcagtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcatgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcggttctgctctggaccattacgatcgttggggtcaaggtactctggtgaccgtctcctcaactagtggccaggccggccagcaccatcaccatcaccatggcgcatacccgtacgacgttccggactacgcttct

SEQ ID NO: 656 - protein, 276 aa, Artificial Sequence
  Description of Artificial Sequence: Synthetic polypeptide
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSSTSGQAGQHHHHHHGAYPYDVPDYAS

SEQ ID NO: 657 - DNA, 822 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccaattgggtgttcggcggagggaccaagctgaccgtcctaggttctagaggtggtggtggtagcggcggcggcggctctggtggtggtggatccctcgagatggcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactacttcaacgattactggggtcaaggtactctggtgaccgtctcctcaactagtggccaggccggccagcaccatcaccatcaccatggcgcatacccgtacgacgttccggactacgcttct

SEQ ID NO: 658 - protein, 274 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSSTSGQAGQHHHHHHGAYPYDVPDYAS

SEQ ID NO: 659 - DNA, 819 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggcccagatgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctctatgttcggtgctcatgattcttggggtcaaggtactctggtgaccgtctcctcaactagtggccaggccggccagcaccatcaccatcaccatggcgcatacccgtacgacgttccggactacgcttct

SEQ ID NO: 660 - protein, 273 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSSTSGQAGQHHHHHHGAYPYDVPDYAS

SEQ ID NO: 661 - DNA, 828 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttttgatgtacactggtaccagctacttccaggaacagcccccaaactcctcatctatgctaacagcaatcggccctcaggggtccctgaccgattctctggctccaagtctggcacctcagcctccctggccatcactgggctcctggctgaggatgaggctgattattactgccagtcctatgacagcagcctgagtggtgtggtattcggcggagggaccaagctgaccgtcctaggttctagaggtggtggtggtagcggcggcggcggctctggtggtggtggatccctcgagatggcccaggtgcagctggtgcaatctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgcggtgcttctttcgaccgtcatgataactggggtcaaggtactctggtgaccgtctcctcaactagtggccaggccggccagcaccatcaccatcaccatggcgcatacccgtacgacgttccggactacgcttct

SEQ ID NO: 662 - protein, 276 aa, Artificial Sequence
  Description of Artificial Sequence: Synthetic polypeptide
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSSTSGQAGQHHHHHHGAYPYDVPDYAS

SEQ ID NO: 663 - DNA, 822 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgctctaactactactacaacgattactggggtcaaggtactctggtgaccgtctcctcaactagtggccaggccggccagcaccatcaccatcaccatggcgcatacccgtacgacgttccggactacgcttct

SEQ ID NO: 664 - protein, 274 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSSTSGQAGQHHHHHHGAYPYDVPDYAS

SEQ ID NO: 665 - DNA, 822 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggttctagaggtggtggtggtagcggcggcggcggctctggtggtggtggatccctcgagatggcccaggtgcagctggtgcagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgctactctggtgtttactacgattggggtcaaggtactctggtgaccgtctcctcaactagtggccaggccggccagcaccatcaccatcaccatggcgcatacccgtacgacgttccggactacgcttct

SEQ ID NO: 666 - protein, 274 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSSTSGQAGQHHHHHHGAYPYDVPDYAS

SEQ ID NO: 667 - DNA, 822 bp, Artificial Sequence
  Description of Artificial Sequence: Synthetic polynucleotide
aattttatgctgactcagccccactctgtgtcggggtctccggggaagacggtaaccatctcctgcaccggcagcagtggcagcattgccgacaactttgtgcagtggtaccagcagcgcccgggcggtgtccccaccactgtgatctttaatgatgacgaaagaccctctggcgtccctgatcggttctctggctccatcgacacctcctccaattctgcctccctcaccatctctggactgaagactgaggacgaggctgactactactgtcagtcttatgataataataatcgaggggtgttcggcggagggaccaagctgaccgtcctaggttctagaggtggtggtggtagcggcggcggcggctctggtggtggtggatccctcgagatggcccaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaaccctaacagtggtaacacaggctatgcacagaagttccagggcagagtcaccatgaccaggaacacctccataagcacagcctacatggagctgagcaacctgagatctgaggacacggccgtgtattactgtgcgcgctactactcttacggttacgattggggtcaaggtactctggtgaccgtctcctcaactagtggccaggccggccagcaccatcaccatcaccatggcgcatacccgtacgacgttccggactacgcttct

SEQ ID NO: 668 - protein, 274 aa, Artificial Sequence
  Description of Artificial Sequence: Synthetic polypeptide
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSSTSGQAGQHHHHHHGAYPYDVPDYAS

SEQ ID NO: 669 - DNA, 840 bp, Artificial Sequence
  Description of Artificial Sequence: Synthetic polynucleotide
cagtctgtcgtgacgcagccgccctcagtgtctggggccccagggcagacggtcaccatctcctgcactgggggcagctccaacatcgggacaggttattttgtaaattggtaccagcaggttccaggaaaagcccccaaactcctcatcctgggtaacaataatcggccctcgggggtccctgaccgactctccggctccacgtccggcacctcagcctccctggccatcactgggctccaggctgaggatgagggtacttattactgccagtcctatgacagcagcctgagtggttatgtcttcggaactgggaccaaggtcaccgtcctaggttctagaggtggtggtggtagcggcggcggcggctctggtggtggtggatccctcgagatggcccaggtacagctgcagcagtcaggtccaggactggtgaagccctcgcagaccctctcactcacctgtggcatctccggggacagtgtctctaccaacagtgttgcttggcactggatcaggcagtccccatcgagaggccttgagtggctgggaaggacatactacaggtccaagtggtctaatgactatggagtatctgtgaaaagtcgaatcaccatcatcccagacacatccaagaaccagttctccctgcagctgaactctgtgactcccgaggacacggctgtgtattactgtgcgcgctcttcttcttggtaccagatcttcgattactggggtcaaggtactctggtgaccgtctcctcaactagtggccaggccggccagcaccatcaccatcaccatggcgcatacccgtacgacgttccggactacgcttct

SEQ ID NO: 670 - protein, 280 aa, Artificial Sequence
  Description of Artificial Sequence: Synthetic polypeptide
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSSTSGQAGQHHHHHHGAYPYDVPDYAS

SEQ ID NO: 671 - DNA, 837 bp, Artificial Sequence
  Description of Artificial Sequence: Synthetic polynucleotide
aattttatgctgactcagccccactctgtgtcggagtctccggggaagacggtaaccatctcctgcaccggcagcagcgacagcatagccaacaactatgttcagtggtaccagcagcgcccgggcagtgcccccaccaatgtgatctacgaagatgtccaaagaccctctggggtccctgatcggttctctgggtccatcgacagctcctccaactctgcctccctcaccatctctggactgaagactgaggacgaggctgtctactattgtcagtcttatcatagcgacaatcgttgggtgttcggcggcgggaccaagctgaccgtcctaggttctagaggtggtggtggtagcggcggcggcggctctggtggtggtggatccctcgagatggcccaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgcgctctggtgcttactgggactactctgtttacgatgaatggggtcaaggtactctggtgaccgtctcctcaactagtggccaggccggccagcaccatcaccatcaccatggcgcatacccgtacgacgttccggactacgcttct

SEQ ID NO: 672 - protein, 279 aa, Artificial Sequence
  Description of Artificial Sequence: Synthetic polypeptide
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSSTSGQAGQHHHHHHGAYPYDVPDYAS

SEQ ID NO: 673 - DNA, 819 bp, Artificial Sequence
  Description of Artificial Sequence: Synthetic polynucleotide
cagtctgtgttgactcagccaccctcagtgtccgtgtccccaggacagacagccaccatcgcctgttctggacataaattgggggataaatatgcttcctggtatcagcagaagtcgggccagtcccctgtgttgatcatctatcaggataataagcggccctcagggattcctgagcgattctctggctccaactctgggaacacagccactctgaccatcagcgggacccaggctctggatgaggctgactattattgtcaggcgtgggacagtagtacttatgtggcattcggcggagggaccaagctgaccgtcctaggttctagaggtggtggtggtagcggcggcggcggctctggtggtggtggatccctcgagatggcccaggtgcagctgcaggagtccggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccatccctcaagagtcgagtcaccatatcagtagacaagtccaagaaccagttctccctgaagctgagctctgtgaccgccgcggacacggccgtgtattactgtgcgcgcatgactactcatactttcggttacgatgcttggggtcaaggtactctggtgaccgtctcctcaactagtggccaggccggccagcaccatcaccatcaccatggcgcatacccgtacgacgttccggactacgcttct

SEQ ID NO: 674 - protein, 273 aa, Artificial Sequence
  Description of Artificial Sequence: Synthetic polypeptide
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSSTSGQAGQHHHHHHGAYPYDVPDYAS

SEQ ID NO: 675 - DNA, 810 bp, Artificial Sequence
  Description of Artificial Sequence: Synthetic polynucleotide
cagcctgtgctgactcagccaccctcagtgtcagtggccccaggaaagacggccacgattacttgtgggggaaacaacattggaagtgaaagtgtgcactggtaccaccagaagccaggccaggcccctgtgttggtcatctatgatgatgccggccggccctcagggatccctgagcgattcactggctccaactctgggaacacggccaccctgaccatcagcagggtcgaagccggggatgaggccgactattactgtcaggtgtgggacagaaatagtgctcagtttgtcttcggacctgggaccaaggtcaccgtcctaggttctagaggtggtggtggtagcggcggcggcggctctggtggtggtggatccctcgagatggccgaggtccagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgttcatctggattggtggggtcaaggtactctggtgaccgtctcctcaactagtggccaggccggccagcaccatcaccatcaccatggcgcatacccgtacgacgttccggactacgcttct

SEQ ID NO: 676 - protein, 270 aa, Artificial Sequence
  Description of Artificial Sequence: Synthetic polypeptide
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSSTSGQAGQHHHHHHGAYPYDVPDYAS

SEQ ID NO: 677 - DNA, 846 bp, Artificial Sequence
  Description of Artificial Sequence: Synthetic polynucleotide
cagtctgtcgtgacgcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggttatgtcttcggaactgggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcctgtacgaaggtggttaccatggttggggttcttggctgtcttctgattcttggggtcaaggtactctggtgaccgtctcctcaactagtggccaggccggccagcaccatcaccatcaccatggcgcatacccgtacgacgttccggactacgcttct

SEQ ID NO: 678 - protein, 282 aa, Artificial Sequence
  Description of Artificial Sequence: Synthetic polypeptide
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSSTSGQAGQHHHHHHGAYPYDVPDYAS

SEQ ID NO: 679 - DNA, 825 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttattgggtgttcggcggagggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgcgcgaaggggcatttgatgcttttgatatctggggccaagggacaatggtcaccgtctcttcaactagtggccaggccggccagcaccatcaccatcaccatggcgcatacccgtacgacgttccggactacgcttct

SEQ ID NO: 680 - protein, 275 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSSTSGQAGQHHHHHHGAYPYDVPDYAS

SEQ ID NO: 681 - DNA, 831 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaattatgtatactggtaccagcagctcccaggaacggcccccaaactcttcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttatctcttcggaactgggaccaaggtcaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaatggcgactccaactactactacggtatggacgtctggggccaagggaccacggtcaccgtctcctcaactagtggccaggccggccagcaccatcaccatcaccatggcgcatacccgtacgacgttccggactacgcttct

SEQ ID NO: 682 - protein, 277 aa, Artificial Sequence
  Description of Artificial Sequence: Synthetic polypeptide
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSSTSGQAGQHHHHHHGAYPYDVPDYAS

SEQ ID NO: 683 - DNA, 843 bp, Artificial Sequence
  Description of Artificial Sequence: Synthetic polynucleotide
cagtctgccctgactcagcctgcctccgtgtccgggtctcctggacagtcgatcaccatctcctgcactggaaccagcagtgacattggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcatctcatatacacgcacctggaacccctatgtcttcgggagtgggaccaaggtcaccgtcctaggttctagaggtggtggtggtagcggcggcggcggctctggtggtggtggatccctcgagatggccgaggtgcagctggtgcagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatcgggcagcagctggctactactactacggtatggacgtctggggccaagggaccacggtcaccgtctcctcaactagtggccaggccggccagcaccatcaccatcaccatggcgcatacccgtacgacgttccggactacgcttct

SEQ ID NO: 684 - protein, 281 aa, Artificial Sequence
  Description of Artificial Sequence: Synthetic polypeptide
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSSTSGQAGQHHHHHHGAYPYDVPDYAS

SEQ ID NO: 685 - DNA, 825 bp, Artificial Sequence
  Description of Artificial Sequence: Synthetic polynucleotide
ctgcctgtgctgactcagccaccctcagtgtccgtgtccccaggacagacagccatcatcacctgctctggagataaattgggggaaaaatatgtttcctggtatcagcagaagccaggccagtcccctgtactggtcatcgatcaagataccaggaggccctcagggatccctgagcgattctctggctccaactctgggaccacagccactctgaccatcagcgggacccaggctatggatgaggctgactattactgtcaggcgtgggacaggggtgtggtattcggcggagggaccaagctgaccgtcctaggttctagaggtggtggtggtagcggcggcggcggctctggtggtggtggatccctcgagatggccgaggtgcagctggtggagtctgggggagacttggtacagcctggcaggtccctgagactctcctgtgcagcctctggattcacctttaatgattatgccatgcactgggtccggcaagctccagggaagggcctggagtgggtctcaggtattagttggagtggtaataacataggctatgcggactctgtgaagggccgattcaccatctccagagacaacgccaagaactccctgtatctgcaaatgaacagtctgagagctgaggacacggccttgtattactgtgcaaaagatagtatacggtatggcatcacctggggaggttttgactactggggccagggaaccctggtcaccgtctcctcaactagtggccaggccggccagcaccatcaccatcaccatggcgcatacccgtacgacgttccggactacgcttct

SEQ ID NO: 686 - protein, 275 aa, Artificial Sequence
  Description of Artificial Sequence: Synthetic polypeptide
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSSTSGQAGQHHHHHHGAYPYDVPDYAS

SEQ ID NO: 687 - DNA, 825 bp, Artificial Sequence
  Description of Artificial Sequence: Synthetic polynucleotide
cagcctgtgctgactcagccaccctcggtgtccaagggcttgagacagaccgccacactcacctgcactgggaacagcaacaatgttggcaacctaggagtagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagtagcctcagtgcttgggtgttcggcggagggaccaagctgaccgtcctaggttctagaggtggtggtggtagcggcggcggcggctctggtggtggtggatccctcgagatggccgaggtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattaattgggatggtggtagcacctactatgcagactctgtgaagggtcgattcaccatctccagagacaacagcaaaaactccctgtatctgcaaatgaacagtctgagagctgaggacaccgccttgtattactgtgcaaaagggatgggcctgagggcgtttgactactggggccagggaaccctggtcaccgtctcctcaactagtggccaggccggccagcaccatcaccatcaccatggcgcatacccgtacgacgttccggactacgcttct

SEQ ID NO: 688 - protein, 275 aa, Artificial Sequence
  Description of Artificial Sequence: Synthetic polypeptide
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSSTSGQAGQHHHHHHGAYPYDVPDYAS

SEQ ID NO: 689 - DNA, 840 bp, Artificial Sequence
  Description of Artificial Sequence: Synthetic polynucleotide
cagtctgtgttgactcagccaccctcagcgtctgggacccccgggcagagggtcaccatctcctgttctggaagcagctccaacatcggaagtaatactgtaaactggtaccagcagctcccaggaacggcccccaaactcctcatctatagtaatgatcagcggccctcaggggtccctgaccgattctctggctccaagtccggcacctcagcctccctggccatcagtgggctccagtctgaggatgaggctgattattactgtgcttcatgggatgacagcctgaatggccgttatgtcttcggaactgggaccaaggtcaccgtcctaggttctagaggtggtggtggtagcggcggcggcggctctggtggtggtggatccctcgagatggcccaggtccagctggtacagtctggggctgaggtgaggaagcctggggcctcagtgaaggtttcctgcaagacttctggatacaccttcagttggtatgctatacattgggtgcgccaggcccccggacaaaggcttgagtggatgggatggatcaacgctggcaatggaaacacaaaatattcacagaaatttcagggcagagtcagtcttaccagggacacatccgcgagcacagcctacatggagctgagcagcctgagatctgatgacacggctgtgtattactgtgcgagacccgataattatggttcgggtggggatgtttttgatatctggggccaagggacaatggtcaccgtctcttcaactagtggccaggccggccagcaccatcaccatcaccatggcgcatacccgtacgacgttccggactacgcttct

SEQ ID NO: 690 - protein, 280 aa, Artificial Sequence
  Description of Artificial Sequence: Synthetic polypeptide
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDIWGQGTMVTVSSTSGQAGQHHHHHHGAYPYDVPDYAS

SEQ ID NO: 691 - DNA, 819 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactttgtgcagtggtaccagcagcgcccgggcagtgcccccacccctatgatctatgaggataacaacagaccccctggggtccctgatcggttctctgcctccgtcgacagctcctccaactctgcctccctcaccatctctggactgaagactgaggacgaggctgactactactgtcagtcttatgataccagcaatgtggtattcggcggggggaccaagctgaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctcaactagtggccaggccggccagcaccatcaccatcaccatggcgcatacccgtacgacgttccggactacgcttct

SEQ ID NO: 692 - protein, 273 aa, Artificial Sequence
  Description of Artificial Sequence: Synthetic polypeptide
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 693 - DNA, 837 bp, Artificial Sequence
  Description of Artificial Sequence: Synthetic polynucleotide
caggctgtgctgactcagccaccctcagcgtctggggcccccgggcagagggtcaccgtctcttgttctggaagcaactccaacatcggaagtaactacgttaactggtaccagcagttcccaggaacggcccccaaactcctcatgtatagtagtagtcagcggccctcaggggtccctgaccgattctctggctccaagtctggcacctcagcctccctggccatcagtgggctccactctgaggatgaggctgattattactgtgctacatgggatgacagcctgaatgcttgggtgttcggcggagggaccaagctgaccgtcctaggttctagaggtggtggtggtagcggcggcggcggctctggtggtggtggatccctcgagatggccgaggtccagctggtgcagtctggggctgaggtgaggaagcctggggcctcagtgaaggtttcctgcaagacttctggatacaccttcacttggtatgctatacattgggtgcgccaggcccccggacaaaggcttgagtggatgggatggatcaacgctggcagtggaaacacaaaatattcacagaaatttcagggcagagtcacccttaccagggacacatccgcgagcacagcgtacatggagctgagcagcctgagatctgatgacacggctgtgtattactgtgcgagacccaataactatggttcgggtggggatgtttttgatatctggggccaagggacaatggtcaccgtctcttcaactagtggccaggccggccagcaccatcaccatcaccatggcgcatacccgtacgacgttccggactacgcttct

SEQ ID NO: 694 - protein, 279 aa, Artificial Sequence
  Description of Artificial Sequence: Synthetic polypeptide
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDIWGQGTMVTVSSTSGQAGQHHHHHHGAYPYDVPDYAS

SEQ ID NO: 695 - DNA, 834 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggttctagaggtggtggtggtagcggcggcggcggctctggtggtggtggatccctcgagatggcccaggtccagctggtgcagtctggggctgaggtgaagaagcctggggcctcagtgaaagtttcctgcaaggcttctggatacaccttcacgaactatgctctgcattgggtgcgccaggcccccggacaagggcttgagtggatggcatggatcaacggtggcaatggtaacacaaaatattcacagaacttccagggcagagtcaccattaccagggacacatccgcgagcacagcctatatggagctgagcagcctgagatctgaagacacggctgtgtattactgtgcgaaaccggaggaaacagctggaacaatccactttgactactggggccagggaaccccggtcaccgtctcctcaactagtggccaggccggccagcaccatcaccatcaccatggcgcatacccgtacgacgttccggactacgcttct

SEQ ID NO: 696 - protein, 278 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSSTSGQAGQHHHHHHGAYPYDVPDYAS

SEQ ID NO: 697 - DNA, 849 bp, Artificial Sequence
  Description of Artificial Sequence: Synthetic polynucleotide
caggctgtgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccatcacggtgttcggcggagggaccaagctgaccgtcctaggttctagaggtggtggtggtagcggcggcggcggctctggtggtggtggatccctcgagatggcccaggtccagctggtacagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgggggagggttactatgatagtagtggttattccaacggtgatgcttttgatatctggggccaagggacaatggtcaccgtctcttcaactagtggccaggccggccagcaccatcaccatcaccatggcgcatacccgtacgacgttccggactacgcttct

SEQ ID NO: 698 - protein, 283 aa, Artificial Sequence
  Description of Artificial Sequence: Synthetic polypeptide
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDIWGQGTMVTVSSTSGQAGQHHHHHHGAYPYDVPDYAS

SEQ ID NO: 699 - DNA, 819 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaaggtcaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctcaactagtggccaggccggccagcaccatcaccatcaccatggcgcatacccgtacgacgttccggactacgcttct

SEQ ID NO: 700 - protein, 273 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 701 - DNA, 828 bp, Artificial Sequence
  Description of Artificial Sequence: Synthetic polynucleotide
tcctatgtgctgactcagccaccctcagtgtccgtgtccccaggacagacagccagcatcacctgctctggagatagattgacgaataaatatgtttcctggtatcaacagaagccaggccagtcccctgtgttggtcatctatgaggatgccaagcggccctcagggatccctgcgcgattctctggctccaactctgggaacacagccactctgaccatcagcgggacccaggctatggatgagtctgaatattactgtcaggcgtgggacagcagtgtggtggtttttggcggagggaccaagctgaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggatttacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagatgaggacacggccttgtattactgtgcaaaagaccgaggggggggagttatcgttaaggatgcttttgatatctggggccaagggacaatggtcaccgtctcttcaactagtggccaggccggccagcaccatcaccatcaccatggcgcatacccgtacgacgttccggactacgcttct

SEQ ID NO: 702 - protein, 276 aa, Artificial Sequence
  Description of Artificial Sequence: Synthetic polypeptide
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSSTSGQAGQHHHHHHGAYPYDVPDYAS

SEQ ID NO: 703 - DNA, 825 bp, Artificial Sequence
  Description of Artificial Sequence: Synthetic polynucleotide
tcctatgagctgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggccgaggtgcagctggtggagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgccagcagggtggtggttggtacgatgtttggggtcaaggtactctggtcaccgtctcctcaactagtggccaggccggccagcaccatcaccatcaccatggcgcatacccgtacgacgttccggactacgcttct

SEQ ID NO: 704 - protein, 275 aa, Artificial Sequence
  Description of Artificial Sequence: Synthetic polypeptide
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSSTSGQAGQHHHHHHGAYPYDVPDYAS

SEQ ID NO: 705 - DNA, 843 bp, Artificial Sequence
  Description of Artificial Sequence: Synthetic polynucleotide
cagtctgtcgtgacgcagccgccctcagtgtctgcggccccaggagagaaggtcaccatctcctgctctggaagcaacttcaatgttggaaataatgatgtatcctggtatcagcaactcccaggtgcagcccccaaactcctcatttatgacaataataagcgaccctcagggattcctgaccgattctctggctccaagtctggcacgtcagccaccctggacatcaccgggctccacagtgacgacgaggccgattattactgcggaacatgggatagcagcctgaatactgggggggtcttcggaactgggaccaaggtcaccgtcctaggttctagaggtggtggtggtagcggcggcggcggctctggtggtggtggatccctcgagatggccgaggtccagctggtgcagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctcaactagtggccaggccggccagcaccatcaccatcaccatggcgcatacccgtacgacgttccggactacgcttct

SEQ ID NO: 706 - protein, 281 aa, Artificial Sequence
  Description of Artificial Sequence: Synthetic polypeptide
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 707 - DNA, 843 bp, Artificial Sequence
  Description of Artificial Sequence: Synthetic polynucleotide
cagtctgtgttgacgcagccgccctcagtgtctgcgcccccgggacagaaggtcaccatctcctgctctggaagcagctccaacattgggaataattatgtatcctggtaccagcagttcccaggaacagcccccaaactcctcatttatgacaataataagcgaccctcagggatttctgaccgattctctggctccaagtctggcacgtcagccaccctgggcatcgccggactccagactggggacgaggccgattattactgcggaacatgggataccagcctgagtggtttttatgtcttcggaagtgggaccaaggtcaccgtcctaggttctagaggtggtggtggtagcggcggcggcggctctggtggtggtggatccctcgagatggccgaggtccagctggtacagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctcaactagtggccaggccggccagcaccatcaccatcaccatggcgcatacccgtacgacgttccggactacgcttct

SEQ ID NO: 708 - protein, 281 aa, Artificial Sequence
  Description of Artificial Sequence: Synthetic polypeptide
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 709 - DNA, 840 bp, Artificial Sequence
  Description of Artificial Sequence: Synthetic polynucleotide
ctgcctgtgctgactcagccaccctcagcgtctgcgacccccgggcagagggtcaccatctcttgttctggaaccacctccaacatcggaagtaatactgtacactggtaccagcagctcccagggacggcccccaaactcctcatctataataataatcagcggccctcaggggtccctgaccgattctctggctccaagtctggcacctcagcctccctggccatcagtgggctccggtccgaggatgaggctacatattcctgtgcaacatgggatgacagcctgagtggtgtggtcttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcccgcctacggtgactacgagtatgatgcttttgatatctggggccaagggacaatggtcaccgtctcttcaactagtggccaggccggccagcaccatcaccatcaccatggcgcatacccgtacgacgttccggactacgcttct

SEQ ID NO: 710 - protein, 280 aa, Artificial Sequence
  Description of Artificial Sequence: Synthetic polypeptide
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDIWGQGTMVTVSSTSGQAGQHHHHHHGAYPYDVPDYAS

SEQ ID NO: 711 - DNA, 825 bp, Artificial Sequence
  Description of Artificial Sequence: Synthetic polynucleotide
cagtctgtgttgacgcagccgccctcagcgtctgggacccccgggcagagggtcaccatctcttgttctggaagcagctccaacatcggaactaatggtgtaaactggttccagcagttcccaggaacggcccccaaactcctcatctatactaatgatcagcggccctcaggggtccctgaccgattctctggctccaagtctggcacctcagcctccctggccatcagtgggctccagtctgcggatgaggctgattattactgtgcagtgtgggaccacagcctgaatggtccggtgttcggcggagggaccaagctgaccgtcctaggttctagaggtggtggtggtagcggcggcggcggctctggtggtggtggatccctcgagatggcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaggggccggttttgatgcttttgatatctggggccaagggacaatggtcaccgtctcttcaactagtggccaggccggccagcaccatcaccatcaccatggcgcatacccgtacgacgttccggactacgcttct

SEQ ID NO: 712 - protein, 275 aa, Artificial Sequence
  Description of Artificial Sequence: Synthetic polypeptide
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSSTSGQAGQHHHHHHGAYPYDVPDYAS

SEQ ID NO: 713 - DNA, 819 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgagactgattattactgtgcagcatgggatgacagcctgaatggttatgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttcaactagtggccaggccggccagcaccatcaccatcaccatggcgcatacccgtacgacgttccggactacgcttct

SEQ ID NO: 714 - protein, 273 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSSTSGQAGQHHHHHHGAYPYDVPDYAS

SEQ ID NO: 715 - DNA, 819 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtatagtaatgatcagcggccctcaggggtccctgaccgattctctggctccaagtctggcacctcagcctccctggccatcagtgggctccagtctgaggatgaggctgattattattgtgcagcatgggatgacagcctgaatggttatgtcttcgcagctgggacccagctcaccgttttaagttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttcaactagtggccaggccggccagcaccatcaccatcaccatggcgcatacccgtacgacgttccggactacgcttct

SEQ ID NO: 716 - protein, 273 aa, Artificial Sequence
  Description of Artificial Sequence: Synthetic polypeptide
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSSTSGQAGQHHHHHHGAYPYDVPDYAS

SEQ ID NO: 717 - DNA, 843 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcactggactccagactggggacgaggccgattattactgcggaacatgggatagcagcctgagtgctgcttatgtcttcggaactgggaccaaggtcaccgtcctaggttctagaggtggtggtggtagcggcggcggcggctctggtggtggtggatccctcgagatggcccaggtccagctggtacagtctggagctgaggtgaagaagcctggggcctcagtgaaggtctcctgcaaggcttctggttacagctttaccagctatactatcagctgggttcgacaggcccctggacaaggccttgagtggatgggatgggtcagcacttacaatggtctcagaaactatgcacagaacctccagggcagagtcaccatgactacagacacactcacgaccacagcctacatggagctgaggagcctcagatctgacgacacggccgtgtattattgtgtgagagaggggtcccccgactacggtgacttcgcggcctttgactactggggccagggcaccctggtcaccgtctcctcaactagtggccaggccggccagcaccatcaccatcaccatggcgcatacccgtacgacgttccggactacgcttct

SEQ ID NO: 718 - protein, 281 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSSTSGQAGQHHHHHHGAYPYDVPDYAS

SEQ ID NO: 719 - DNA, 816 bp, Artificial Sequence
  Description of Artificial Sequence: Synthetic polynucleotide
caggctgtgctgactcagccaccctcagcgtctgagacccccgggcagagggtcaccatctcttgttctggaagcaggtccaacatcggaactaatattgtacactggtaccagcagcgcccaggaatggcccccaaactcctcacttatggtagtcggcggccctcaggggtcccggaccgattctctggctccaagtttggcacctcagcctccctggccatcagtgggctccagtctgaggatgaggctgattattattgtgcagcatgggatgacagtctgaatggtccggctttcggcggagggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagacggtgggggctactttgactactggggccagggaaccctggtcaccgtctcctcaactagtggccaggccggccagcaccatcaccatcaccatggcgcatacccgtacgacgttccggactacgcttct

SEQ ID NO: 720 - protein, 272 aa, Artificial Sequence
  Description of Artificial Sequence: Synthetic polypeptide
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSSTSGQAGQHHHHHHGAYPYDVPDYAS

SEQ ID NO: 721 - DNA, 837 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaatatcggggcacgttatgatgtacactggtaccagcaactcccaggaacagccccccgactcctcatctctgctaactacgatcggccctcaggggtccctgaccgattctctggctccaagtctggcacctcagcctccctggccatcactgggctccaggctgaggatgaggctgattattactgccagtcctatgacagcagtgtgagtgcttgggtgttcggcggagggaccaaggtcaccgtcctaggttctagaggtggtggtggtagcggcggcggcggctctggtggtggtggatccctcgagatggccgaagtgcagctggtgcagtctggggctgaagtgaaggagcctggggcctcagtgaggatctcctgccaggcatctggatacaacttcatcagttattatatgcactgggtgcggcaggcccctgggcaaggtcttgagtggatgggcaccatcaacccaggcagtggtgagacagactactcacagaagttgcagggcagagtcaccatgaccagggacccgtccacgggtacattcgacatggggctgagcagcctgacatctggggacacggccgtctattattgtgcgacaggtctcatcagaggagctagcgatgcttttaatatctggggccgggggacaatggtcaccgtctcttcaactagtggccaggccggccagcaccatcaccatcaccatggcgcatacccgtacgacgttccggactacgcttct

SEQ ID NO: 722 - protein, 279 aa, Artificial Sequence
  Description of Artificial Sequence: Synthetic polypeptide
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNIWGRGTMVTVSSTSGQAGQHHHHHHGAYPYDVPDYAS

SEQ ID NO: 723 - DNA, 825 bp, Artificial Sequence
  Description of Artificial Sequence: Synthetic polynucleotide
cagcctgtgctgactcagccaccctcagtgtccgtgtccccaggacagacggccgccatcccctgttctggagataagttgggggataaatttgcttcctggtatcagcagaagccaggccagtcccctgtgctggtcatctatcaagatactaagcggccctcagggatccctgagcgattctctggctccaactctgggaacacagccactctgaccatcagcgggacccaggctatggatgaggctgactattactgtcagacgtgggccagcggcattgtggtgttcggcggagggaccaagctgaccgtcctaggttctagaggtggtggtggtagcggcggcggcggctctggtggtggtggatccctcgagatggcccaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagcgcagtggctggaagggatttgactactggggccagggaaccctggtcaccgtctcctcaactagtggccaggccggccagcaccatcaccatcaccatggcgcatacccgtacgacgttccggactacgcttct

SEQ ID NO: 724 - protein, 275 aa, Artificial Sequence
  Description of Artificial Sequence: Synthetic polypeptide
QPVLTQPPSVSVSPGQTAAIPCSGDKLGDKFASWYQQKPGQSPVLVIYQDTKRPSGIPERFSGSNSGNTATLTISGTQAMDEADYYCQTWASGIVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSSTSGQAGQHHHHHHGAYPYDVPDYAS

SEQ ID NO: 725 - DNA, 834 bp, Artificial Sequence
  Description of Artificial Sequence: Synthetic polynucleotide
gatgttgtgatgactcagtctccaccctccctgtccgtcacccctggagagccggcctccatcacctgcaggtctagtcagagcctcctggaaagaaatgcatacaactacttggattggtacctgcagaggccaggacagtctccacagctcctgatctacttgggttctaatcgggccgccggggtccctgacaggttcagtggcagtggatcaggcagagattttacactgaaaatcagcagagtggagcctgaggatgttggggtttattactgcatgcaagctctacaagctccgttcactttcggcggagggaccaaggtggagatcaaacgttctagaggtggtggtggtagcggcggcggcggctctggtggtggtggatccctcgagatggccgaagtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatggggcccgtttcaggatgcttttgatatctggggccaagggacaatggtcaccgtctcttcaactagtggccaggccggccagcaccatcaccatcaccatggcgcatacccgtacgacgttccggactacgcttct

SEQ ID NO: 726 - protein, 278 aa, Artificial Sequence
  Description of Artificial Sequence: Synthetic polypeptide
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSSTSGQAGQHHHHHHGAYPYDVPDYAS

SEQ ID NO: 727 - DNA, 843 bp, Artificial Sequence
  Description of Artificial Sequence: Synthetic polynucleotide
caggctgtgctgactcagcctgcctccgtgtctgggtctcctggacagtcgatcaccatctcctgcactggaaccagcagtgacgttggtggttataactatgtctcctggtaccaacagcacccgggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggagcagggaccaaggtcaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagccaggtggacagcagtggcatcagaccaccactttgactactggggccagggaacgctggtcaccgtctcctcaactagtggccaggccggccagcaccatcaccatcaccatggcgcatacccgtacgacgttccggactacgcttct

SEQ ID NO: 728 - protein, 281 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSSTSGQAGQHHHHHHGAYPYDVPDYAS

SEQ ID NO: 729 - DNA, 819 bp, Artificial Sequence
  Description of Artificial Sequence: Synthetic polynucleotide
caggctgtgcttactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaagctgaccgtcctaggttctagaggtggtggtggtagcggcggcggcggctctggtggtggtggatccctcgagatggccgaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagattgggactacatggacgtctggggcaaagggaccacggtcaccgtctcctcaactagtggccaggccggccagcaccatcaccatcaccatggcgcatacccgtacgacgttccggactacgcttct

SEQ ID NO: 730 - protein, 273 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSSTSGQAGQHHHHHHGAYPYDVPDYAS

SEQ ID NO: 731 - DNA, 852 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggccgaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctcaactagtggccaggccggccagcaccatcaccatcaccatggcgcatacccgtacgacgttccggactacgcttct

SEQ ID NO: 732 - protein, 284 aa, Artificial Sequence
  Description of Artificial Sequence: Synthetic polypeptide
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAEVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 733 - DNA, 855 bp, Artificial Sequence
  Description of Artificial Sequence: Synthetic polynucleotide
cagtctgtgttgacgcagccgccctcagtgtctggggccccagggcagagggtcaccgtctcctgcactgggagcagatccaacatcggggcaggatatgatgtacactggtaccagcaacttccaggaacagcccccaaactcctcatctatggaaatagtaatcggcctccaggggtccctgaccgattctctgggtctaagtctggcacctcagcctccctggtcatcactgggctccaggctgaggatgccgctgattattactgccagtcctatgacaacactgtgcgtgaatcaccttatgtcttcggaactgggaccaaggtcaccgtcctaggttctagaggtggtggtggtagcggcggcggcggctctggtggtggtggatccctcgagatggccgaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagagtaatttagtgtcccggcactactactactacggtatggacgtctggggccaagggaccacggtcaccgtctcctcaactagtggccaggccggccagcaccatcaccatcaccatggcgcatacccgtacgacgttccggactacgcttct

SEQ ID NO: 734 - protein, 285 aa, Artificial Sequence
  Description of Artificial Sequence: Synthetic polypeptide
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSSTSGQAGQHHHHHHGAYPYDVPDYAS

SEQ ID NO: 735 - DNA, 867 bp, Artificial Sequence
  Description of Artificial Sequence: Synthetic polynucleotide
ctgcctgtgctgactcagccaccctcagcgtctgggacccccgggcagagggtcaccatctcttgttctggaaccagctccaacatcggaagtaattctgtagactggtaccagcagctcccaggaacggcccccaaactcctcatctatagtaataatcagcggccctcaggggtccctgaccgaatctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggccgaagtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagattacggatactatggttcggggagttattcgagcggccccctttactactactacggtatggacgtctggggccaagggaccacggtcaccgtctcctcaactagtggccaggccggccagcaccatcaccatcaccatggcgcatacccgtacgacgttccggactacgcttct

SEQ ID NO: 736 - protein, 289 aa, Artificial Sequence
  Description of Artificial Sequence: Synthetic polypeptide
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSSTSGQAGQHHHHHHGAYPYDVPDYAS

SEQ ID NO: 737 - DNA, 852 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtataataatgatcagcggccctcaggggtccctgaccgattctctggctccaagtctggcacctcagcctccctggccatcagtgggctccagtctgaggatgaggctgattattactgtgcagcatgggatgacagcctcaatggttatgtcttcggacctgggaccaaggtcaccgtcctaggttctagaggtggtggtggtagcggcggcggcggctctggtggtggtggatccctcgagatggcccaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctcaactagtggccaggccggccagcaccatcaccatcaccatggcgcatacccgtacgacgttccggactacgcttct

SEQ ID NO: 738 - protein, 284 aa, Artificial Sequence
  Description of Artificial Sequence: Synthetic polypeptide
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 739 - DNA, 831 bp, Artificial Sequence
  Description of Artificial Sequence: Synthetic polynucleotide
aattttatgctgactcagccccacgctgtgtcggagtctccggggaagacggtaaccatctcctgcacccgcagcagtggcagtattgccagcaactatgtgcagtggtaccagcagcgcccgggcagttccccccgcactgtgatttatgaggataatcaaagaccctctggggtccctggtcggttctctggctccatcgacagctcctccaactctgcctccctcaccatctctggactgaagactgaggacgaggctgactactactgtcagtcttatgattccaccagtgtgcttttcggcggagggaccaagctgaccgtcctaggttctagaggtggtggtggtagcggcggcggcggctctggtggtggtggatccctcgagatggccgaggtccagctggtgcagtctggggctgaggtgaagaagccagggtcctcggtgaaggtctcctgcaaggcctcgggaggcaccttcagcagcaattctctcagctgggtgcgacaggcccctggacaagggcttgagtggatgggaaggatcttccctatcctgggtataacaaactatgcacagaagttccagggcagagtcacgattaccgcggacaaatccacgagcacagcctacatggagctgagcagcctgagatctgaggacacggccgtctattactgtgcgagaggaaactaccaatggtatgatgcttttgatatctggggccaagggacaatggtcaccgtctcttcaactagtggccaggccggccagcaccatcaccatcaccatggcgcatacccgtacgacgttccggactacgcttct

SEQ ID NO: 740 - protein, 277 aa, Artificial Sequence
  Description of Artificial Sequence: Synthetic polypeptide
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDIWGQGTMVTVSSTSGQAGQHHHHHHGAYPYDVPDYAS

SEQ ID NO: 741 - DNA, 819 bp, Artificial Sequence
  Description of Artificial Sequence: Synthetic polynucleotide
cagcctgtgctgactcagccaccctcagtgtcagtggtcccaggaaagacggccaggattacctgtgggggaaaaaacattggaagtaaaagtgtgcactggtaccagcagaagccaggccaggcccctgtggtggtcatccattatgatagtgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccaactatggtatcagctgggtgcgacaggcccctggacaagggcttgagtggatgggatggatcagcgcttacaatggtaacacaaactatgcacataagctccagggcagagtcaccatgaccacagacacatccacgagcacagccaacatggagctgaggagcctgagacctgacgacactgccgtgtattactgtgcgcgctcttacttcggttctcatgattactggggtcaaggtactctggtgaccgtctcctcaactagtggccaggccggccagcaccatcaccatcaccatggcgcatacccgtacgacgttccggactacgcttct

SEQ ID NO: 742 - protein, 273 aa, Artificial Sequence
  Description of Artificial Sequence: Synthetic polypeptide
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSSTSGQAGQHHHHHHGAYPYDVPDYAS

SEQ ID NO: 743 - DNA, 834 bp, Artificial Sequence
  Description of Artificial Sequence: Synthetic polynucleotide
tcctatgtgctgactcagccaccctcggtgtcagtggccccaggaaagacggccaggatttcctgtgggggaaacgacattggaagtaaaagtgttttctggtatcagcagaggccaggccaggcccctgtgttggtcgtctatgatgatagcgaccggccctcagggctccctgagcgattctctggcttcaactctgggaacacggccaccctgaccatcagcagggtcgaagccggggatgaggccgactattactgtcaagtgtgggatagtagtagtgatcattatgtcttcggaactgggaccaaggtcaccgtcctaggttctagaggtggtggtggtagcggcggcggcggctctggtggtggtggatccctcgagatggcccaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataacctatggttcggggagttatggtgcttttgatatctggggccaagggacaatggtcaccgtctcttcaactagtggccaggccggccagcaccatcaccatcaccatggcgcatacccgtacgacgttccggactacgcttct

SEQ ID NO: 744 - protein, 278 aa, Artificial Sequence
  Description of Artificial Sequence: Synthetic polypeptide
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSSTSGQAGQHHHHHHGAYPYDVPDYAS

SEQ ID NO: 745 - DNA, 822 bp, Artificial Sequence; identical to SEQ ID NO: 593
  Description of Artificial Sequence: Synthetic polynucleotide

SEQ ID NO: 746 - protein, 274 aa, Artificial Sequence; identical to SEQ ID NO: 594
  Description of Artificial Sequence: Synthetic polypeptide

SEQ ID NO: 747 - DNA, 822 bp, Artificial Sequence; identical to SEQ ID NO: 595
  Description of Artificial Sequence: Synthetic polynucleotide

SEQ ID NO: 748 - protein, 274 aa, Artificial Sequence; identical to SEQ ID NO: 596
  Description of Artificial Sequence: Synthetic polypeptide

SEQ ID NO: 749 - DNA, 825 bp, Artificial Sequence; identical to SEQ ID NO: 597
  Description of Artificial Sequence: Synthetic polynucleotide

SEQ ID NO: 750 - protein, 275 aa, Artificial Sequence; identical to SEQ ID NO: 598
  Description of Artificial Sequence: Synthetic polypeptide

SEQ ID NO: 751 - DNA, 819 bp, Artificial Sequence; identical to SEQ ID NO: 599
  Description of Artificial Sequence: Synthetic polynucleotide

SEQ ID NO: 752 - protein, 273 aa, Artificial Sequence; identical to SEQ ID NO: 600
  Description of Artificial Sequence: Synthetic polypeptide

SEQ ID NO: 753 - DNA, 813 bp, Artificial Sequence; identical to SEQ ID NO: 601
  Description of Artificial Sequence: Synthetic polynucleotide

SEQ ID NO: 754 - protein, 271 aa, Artificial Sequence; identical to SEQ ID NO: 602
  Description of Artificial Sequence: Synthetic polypeptide

SEQ ID NO: 755 - DNA, 834 bp, Artificial Sequence; identical to SEQ ID NO: 603
  Description of Artificial Sequence: Synthetic polynucleotide

SEQ ID NO: 756 - protein, 278 aa, Artificial Sequence; identical to SEQ ID NO: 604
  Description of Artificial Sequence: Synthetic polypeptide

SEQ ID NO: 757 - DNA, 831 bp, Artificial Sequence; identical to SEQ ID NO: 605
  Description of Artificial Sequence: Synthetic polynucleotide

SEQ ID NO: 758 - protein, 277 aa, Artificial Sequence; identical to SEQ ID NO: 606
  Description of Artificial Sequence: Synthetic polypeptide

SEQ ID NO: 759 - DNA, 822 bp, Artificial Sequence; identical to SEQ ID NO: 607
  Description of Artificial Sequence: Synthetic polynucleotide

SEQ ID NO: 760 - protein, 274 aa, Artificial Sequence; identical to SEQ ID NO: 608
  Description of Artificial Sequence: Synthetic polypeptide

SEQ ID NO: 761 - DNA, 825 bp, Artificial Sequence; identical to SEQ ID NO: 609
  Description of Artificial Sequence: Synthetic polynucleotide

SEQ ID NO: 762 - protein, 275 aa, Artificial Sequence; identical to SEQ ID NO: 610
  Description of Artificial Sequence: Synthetic polypeptide

SEQ ID NO: 763 - DNA, 822 bp, Artificial Sequence; identical to SEQ ID NO: 611
  Description of Artificial Sequence: Synthetic polynucleotide

SEQ ID NO: 764 - protein, 274 aa, Artificial Sequence; identical to SEQ ID NO: 612
  Description of Artificial Sequence: Synthetic polypeptide

SEQ ID NO: 765 - DNA, 828 bp, Artificial Sequence; identical to SEQ ID NO: 613
  Description of Artificial Sequence: Synthetic polynucleotide

SEQ ID NO: 766 - protein, 276 aa, Artificial Sequence; identical to SEQ ID NO: 614
  Description of Artificial Sequence: Synthetic polypeptide

SEQ ID NO: 767 - DNA, 822 bp, Artificial Sequence; identical to SEQ ID NO: 615
  Description of Artificial Sequence: Synthetic polynucleotide

SEQ ID NO: 768 - protein, 274 aa, Artificial Sequence; identical to SEQ ID NO: 616
  Description of Artificial Sequence: Synthetic polypeptide

SEQ ID NO: 769 - DNA, 816 bp, Artificial Sequence; identical to SEQ ID NO: 617
  Description of Artificial Sequence: Synthetic polynucleotide

SEQ ID NO: 770 - protein, 272 aa, Artificial Sequence; identical to SEQ ID NO: 618
  Description of Artificial Sequence: Synthetic polypeptide

SEQ ID NO: 771 - DNA, 810 bp, Artificial Sequence; identical to SEQ ID NO: 619
  Description of Artificial Sequence: Synthetic polynucleotide

SEQ ID NO: 772 - protein, 270 aa, Artificial Sequence; identical to SEQ ID NO: 620
  Description of Artificial Sequence: Synthetic polypeptide

SEQ ID NO: 773 - DNA, 810 bp, Artificial Sequence; identical to SEQ ID NO: 621
  Description of Artificial Sequence: Synthetic polynucleotide

SEQ ID NO: 774 - protein, 270 aa, Artificial Sequence; identical to SEQ ID NO: 622
  Description of Artificial Sequence: Synthetic polypeptide

SEQ ID NO: 775 - DNA, 816 bp, Artificial Sequence; identical to SEQ ID NO: 623
  Description of Artificial Sequence: Synthetic polynucleotide

SEQ ID NO: 776 - protein, 272 aa, Artificial Sequence; identical to SEQ ID NO: 624
  Description of Artificial Sequence: Synthetic polypeptide

SEQ ID NO: 777 - DNA, 870 bp, Artificial Sequence; identical to SEQ ID NO: 625
  Description of Artificial Sequence: Synthetic polynucleotide

SEQ ID NO: 778 - protein, 290 aa, Artificial Sequence; identical to SEQ ID NO: 626
  Description of Artificial Sequence: Synthetic polypeptide

SEQ ID NO: 779 - DNA, 822 bp, Artificial Sequence; identical to SEQ ID NO: 627
  Description of Artificial Sequence: Synthetic polynucleotide

SEQ ID NO: 780 - protein, 274 aa, Artificial Sequence; identical to SEQ ID NO: 628
  Description of Artificial Sequence: Synthetic polypeptide

SEQ ID NO: 781 - DNA, 822 bp, Artificial Sequence; identical to SEQ ID NO: 629
  Description of Artificial Sequence: Synthetic polynucleotide

SEQ ID NO: 782 - protein, 274 aa, Artificial Sequence; identical to SEQ ID NO: 630
  Description of Artificial Sequence: Synthetic polypeptide

SEQ ID NO: 783 - DNA, 831 bp, Artificial Sequence; identical to SEQ ID NO: 631
  Description of Artificial Sequence: Synthetic polynucleotide

SEQ ID NO: 784 - protein, 277 aa, Artificial Sequence; identical to SEQ ID NO: 632
  Description of Artificial Sequence: Synthetic polypeptide

SEQ ID NO: 785 - DNA, 822 bp, Artificial Sequence; identical to SEQ ID NO: 633
  Description of Artificial Sequence: Synthetic polynucleotide

SEQ ID NO: 786 - protein, 274 aa, Artificial Sequence; identical to SEQ ID NO: 634
  Description of Artificial Sequence: Synthetic polypeptide

SEQ ID NO: 787 - DNA, 825 bp, Artificial Sequence; identical to SEQ ID NO: 635
  Description of Artificial Sequence: Synthetic polynucleotide

SEQ ID NO: 788 - protein, 275 aa, Artificial Sequence; identical to SEQ ID NO: 636
  Description of Artificial Sequence: Synthetic polypeptide

SEQ ID NO: 789 - DNA, 816 bp, Artificial Sequence; identical to SEQ ID NO: 637
  Description of Artificial Sequence: Synthetic polynucleotide

SEQ ID NO: 790 - protein, 272 aa, Artificial Sequence; identical to SEQ ID NO: 638
  Description of Artificial Sequence: Synthetic polypeptide

SEQ ID NO: 791 - DNA, 822 bp, Artificial Sequence; identical to SEQ ID NO: 639
  Description of Artificial Sequence: Synthetic polynucleotide

SEQ ID NO: 792 - protein, 274 aa, Artificial Sequence; identical to SEQ ID NO: 640
  Description of Artificial Sequence: Synthetic polypeptide

SEQ ID NO: 793 - DNA, 852 bp, Artificial Sequence; identical to SEQ ID NO: 641
  Description of Artificial Sequence: Synthetic polynucleotide

SEQ ID NO: 794 - protein, 284 aa, Artificial Sequence; identical to SEQ ID NO: 642
  Description of Artificial Sequence: Synthetic polypeptide

SEQ ID NO: 795 - DNA, 828 bp, Artificial Sequence; identical to SEQ ID NO: 643
  Description of Artificial Sequence: Synthetic polynucleotide

SEQ ID NO: 796 - protein, 276 aa, Artificial Sequence; identical to SEQ ID NO: 644
  Description of Artificial Sequence: Synthetic polypeptide

SEQ ID NO: 797 - DNA, 822 bp, Artificial Sequence; identical to SEQ ID NO: 645
  Description of Artificial Sequence: Synthetic polynucleotide

SEQ ID NO: 798 - protein, 274 aa, Artificial Sequence; identical to SEQ ID NO: 646
  Description of Artificial Sequence: Synthetic polypeptide

SEQ ID NO: 799 - DNA, 825 bp, Artificial Sequence; identical to SEQ ID NO: 647
  Description of Artificial Sequence: Synthetic polynucleotide

SEQ ID NO: 800 - protein, 275 aa, Artificial Sequence; identical to SEQ ID NO: 648
  Description of Artificial Sequence: Synthetic polypeptide

SEQ ID NO: 801 - DNA, 807 bp, Artificial Sequence; identical to SEQ ID NO: 649
  Description of Artificial Sequence: Synthetic polynucleotide

SEQ ID NO: 802 - protein, 269 aa, Artificial Sequence; identical to SEQ ID NO: 650
  Description of Artificial Sequence: Synthetic polypeptide

SEQ ID NO: 803 - DNA, 828 bp, Artificial Sequence; identical to SEQ ID NO: 651
  Description of Artificial Sequence: Synthetic polynucleotide

SEQ ID NO: 804 - protein, 276 aa, Artificial Sequence; identical to SEQ ID NO: 652
  Description of Artificial Sequence: Synthetic polypeptide

SEQ ID NO: 805 - DNA, 819 bp, Artificial Sequence; identical to SEQ ID NO: 653
  Description of Artificial Sequence: Synthetic polynucleotide

SEQ ID NO: 806 - protein, 273 aa, Artificial Sequence; identical to SEQ ID NO: 654
  Description of Artificial Sequence: Synthetic polypeptide

SEQ ID NO: 807 - DNA, 828 bp, Artificial Sequence; identical to SEQ ID NO: 655
  Description of Artificial Sequence: Synthetic polynucleotide

SEQ ID NO: 808 - protein, 276 aa, Artificial Sequence; identical to SEQ ID NO: 656
  Description of Artificial Sequence: Synthetic polypeptide

SEQ ID NO: 809 - DNA, 822 bp, Artificial Sequence; identical to SEQ ID NO: 657
  Description of Artificial Sequence: Synthetic polynucleotide

SEQ ID NO: 810 - protein, 274 aa, Artificial Sequence; identical to SEQ ID NO: 658
  Description of Artificial Sequence: Synthetic polypeptide

SEQ ID NO: 811 - DNA, 819 bp, Artificial Sequence; identical to SEQ ID NO: 659
  Description of Artificial Sequence: Synthetic polynucleotide

SEQ ID NO: 812 - protein, 273 aa, Artificial Sequence; identical to SEQ ID NO: 660
  Description of Artificial Sequence: Synthetic polypeptide

SEQ ID NO: 813 - DNA, 828 bp, Artificial Sequence; identical to SEQ ID NO: 661
  Description of Artificial Sequence: Synthetic polynucleotide

SEQ ID NO: 814 - protein, 276 aa, Artificial Sequence; identical to SEQ ID NO: 662
  Description of Artificial Sequence: Synthetic polypeptide

SEQ ID NO: 815 - DNA, 822 bp, Artificial Sequence; identical to SEQ ID NO: 663
  Description of Artificial Sequence: Synthetic polynucleotide

SEQ ID NO: 816 - protein, 274 aa, Artificial Sequence; identical to SEQ ID NO: 664
  Description of Artificial Sequence: Synthetic polypeptide

SEQ ID NO: 817 - DNA, 822 bp, Artificial Sequence; identical to SEQ ID NO: 665
  Description of Artificial Sequence: Synthetic polynucleotide

SEQ ID NO: 818 - protein, 274 aa, Artificial Sequence; identical to SEQ ID NO: 666
  Description of Artificial Sequence: Synthetic polypeptide

SEQ ID NO: 819 - DNA, 822 bp, Artificial Sequence; identical to SEQ ID NO: 667
  Description of Artificial Sequence: Synthetic polynucleotide

SEQ ID NO: 820 - protein, 274 aa, Artificial Sequence; identical to SEQ ID NO: 668
  Description of Artificial Sequence: Synthetic polypeptide

SEQ ID NO: 821 - DNA, 840 bp, Artificial Sequence; identical to SEQ ID NO: 669
  Description of Artificial Sequence: Synthetic polynucleotide

SEQ ID NO: 822 - protein, 280 aa, Artificial Sequence; identical to SEQ ID NO: 670
  Description of Artificial Sequence: Synthetic polypeptide

SEQ ID NO: 823 - DNA, 837 bp, Artificial Sequence; identical to SEQ ID NO: 671
  Description of Artificial Sequence: Synthetic polynucleotide

SEQ ID NO: 824 - protein, 279 aa, Artificial Sequence; identical to SEQ ID NO: 672
  Description of Artificial Sequence: Synthetic polypeptide

SEQ ID NO: 825 - DNA, 819 bp, Artificial Sequence; identical to SEQ ID NO: 673
  Description of Artificial Sequence: Synthetic polynucleotide

SEQ ID NO: 826 - protein, 273 aa, Artificial Sequence; identical to SEQ ID NO: 674
  Description of Artificial Sequence: Synthetic polypeptide

SEQ ID NO: 827 - DNA, 810 bp, Artificial Sequence; identical to SEQ ID NO: 675
  Description of Artificial Sequence: Synthetic polynucleotide

SEQ ID NO: 828 - protein, 270 aa, Artificial Sequence; identical to SEQ ID NO: 676
  Description of Artificial Sequence: Synthetic polypeptide

SEQ ID NO: 829 - DNA, 846 bp, Artificial Sequence; identical to SEQ ID NO: 677
  Description of Artificial Sequence: Synthetic polynucleotide

SEQ ID NO: 830 - protein, 282 aa, Artificial Sequence; identical to SEQ ID NO: 678
  Description of Artificial Sequence: Synthetic polypeptide

SEQ ID NO: 831 - DNA, 825 bp, Artificial Sequence; identical to SEQ ID NO: 679
  Description of Artificial Sequence: Synthetic polynucleotide

SEQ ID NO: 832 - protein, 275 aa, Artificial Sequence; identical to SEQ ID NO: 680
  Description of Artificial Sequence: Synthetic polypeptide

SEQ ID NO: 833 - DNA, 831 bp, Artificial Sequence; identical to SEQ ID NO: 681
  Description of Artificial Sequence: Synthetic polynucleotide

SEQ ID NO: 834 - protein, 277 aa, Artificial Sequence; identical to SEQ ID NO: 682
  Description of Artificial Sequence: Synthetic polypeptide

SEQ ID NO: 835 - DNA, 843 bp, Artificial Sequence; identical to SEQ ID NO: 683
  Description of Artificial Sequence: Synthetic polynucleotide

SEQ ID NO: 836 - protein, 281 aa, Artificial Sequence; identical to SEQ ID NO: 684
  Description of Artificial Sequence: Synthetic polypeptide

SEQ ID NO: 837 - DNA, 825 bp, Artificial Sequence; identical to SEQ ID NO: 685
  Description of Artificial Sequence: Synthetic polynucleotide

SEQ ID NO: 838 - protein, 275 aa, Artificial Sequence; identical to SEQ ID NO: 686
  Description of Artificial Sequence: Synthetic polypeptide

SEQ ID NO: 839 - DNA, 825 bp, Artificial Sequence; identical to SEQ ID NO: 687
  Description of Artificial Sequence: Synthetic polynucleotide

SEQ ID NO: 840 - protein, 275 aa, Artificial Sequence; identical to SEQ ID NO: 688
  Description of Artificial Sequence: Synthetic polypeptide

SEQ ID NO: 841 - DNA, 840 bp, Artificial Sequence; identical to SEQ ID NO: 689
  Description of Artificial Sequence: Synthetic polynucleotide

SEQ ID NO: 842 - protein, 280 aa, Artificial Sequence; identical to SEQ ID NO: 690
  Description of Artificial Sequence: Synthetic polypeptide

SEQ ID NO: 843 - DNA, 819 bp, Artificial Sequence; identical to SEQ ID NO: 691
  Description of Artificial Sequence: Synthetic polynucleotide

SEQ ID NO: 844 - protein, 273 aa, Artificial Sequence; identical to SEQ ID NO: 692
  Description of Artificial Sequence: Synthetic polypeptide

SEQ ID NO: 845 - DNA, 837 bp, Artificial Sequence; identical to SEQ ID NO: 693
  Description of Artificial Sequence: Synthetic polynucleotide

SEQ ID NO: 846 - protein, 279 aa, Artificial Sequence; identical to SEQ ID NO: 694
  Description of Artificial Sequence: Synthetic polypeptide

SEQ ID NO: 847 - DNA, 834 bp, Artificial Sequence; identical to SEQ ID NO: 695
  Description of Artificial Sequence: Synthetic polynucleotide

SEQ ID NO: 848 - protein, 278 aa, Artificial Sequence; identical to SEQ ID NO: 696
  Description of Artificial Sequence: Synthetic polypeptide

SEQ ID NO: 849 - DNA, 849 bp, Artificial Sequence; identical to SEQ ID NO: 697
  Description of Artificial Sequence: Synthetic polynucleotide

SEQ ID NO: 850 - protein, 283 aa, Artificial Sequence; identical to SEQ ID NO: 698
  Description of Artificial Sequence: Synthetic polypeptide

SEQ ID NO: 851 - DNA, 819 bp, Artificial Sequence; identical to SEQ ID NO: 699
  Description of Artificial Sequence: Synthetic polynucleotide

SEQ ID NO: 852 - protein, 273 aa, Artificial Sequence; identical to SEQ ID NO: 700
  Description of Artificial Sequence: Synthetic polypeptide

SEQ ID NO: 853 - DNA, 828 bp, Artificial Sequence; identical to SEQ ID NO: 701
  Description of Artificial Sequence: Synthetic polynucleotide

SEQ ID NO: 854 - protein, 276 aa, Artificial Sequence; identical to SEQ ID NO: 702
  Description of Artificial Sequence: Synthetic polypeptide

SEQ ID NO: 855 - DNA, 825 bp, Artificial Sequence; identical to SEQ ID NO: 703
  Description of Artificial Sequence: Synthetic polynucleotide

SEQ ID NO: 856 - protein, 275 aa, Artificial Sequence; identical to SEQ ID NO: 704
  Description of Artificial Sequence: Synthetic polypeptide

SEQ ID NO: 857 - DNA, 843 bp, Artificial Sequence; identical to SEQ ID NO: 705
  Description of Artificial Sequence: Synthetic polynucleotide

SEQ ID NO: 858 - protein, 281 aa, Artificial Sequence; identical to SEQ ID NO: 706
  Description of Artificial Sequence: Synthetic polypeptide

SEQ ID NO: 859 - DNA, 843 bp, Artificial Sequence; identical to SEQ ID NO: 707
  Description of Artificial Sequence: Synthetic polynucleotide

SEQ ID NO: 860 - protein, 281 aa, Artificial Sequence; identical to SEQ ID NO: 708
  Description of Artificial Sequence: Synthetic polypeptide

SEQ ID NO: 861 - DNA, 840 bp, Artificial Sequence; identical to SEQ ID NO: 709
  Description of Artificial Sequence: Synthetic polynucleotide

SEQ ID NO: 862 - protein, 280 aa, Artificial Sequence; identical to SEQ ID NO: 710
  Description of Artificial Sequence: Synthetic polypeptide

SEQ ID NO: 863 - DNA, 825 bp, Artificial Sequence; identical to SEQ ID NO: 711
  Description of Artificial Sequence: Synthetic polynucleotide

SEQ ID NO: 864 - protein, 275 aa, Artificial Sequence; identical to SEQ ID NO: 712
  Description of Artificial Sequence: Synthetic polypeptide

SEQ ID NO: 865 - DNA, 819 bp, Artificial Sequence; identical to SEQ ID NO: 713
  Description of Artificial Sequence: Synthetic polynucleotide

SEQ ID NO: 866 - protein, 273 aa, Artificial Sequence; identical to SEQ ID NO: 714
  Description of Artificial Sequence: Synthetic polypeptide

SEQ ID NO: 867 - DNA, 819 bp, Artificial Sequence; identical to SEQ ID NO: 715
  Description of Artificial Sequence: Synthetic polynucleotide

SEQ ID NO: 868 - protein, 273 aa, Artificial Sequence; identical to SEQ ID NO: 716
  Description of Artificial Sequence: Synthetic polypeptide

SEQ ID NO: 869 - DNA, 843 bp, Artificial Sequence; identical to SEQ ID NO: 717
  Description of Artificial Sequence: Synthetic polynucleotide

SEQ ID NO: 870 - protein, 281 aa, Artificial Sequence; identical to SEQ ID NO: 718
  Description of Artificial Sequence: Synthetic polypeptide

SEQ ID NO: 871 - DNA, 816 bp, Artificial Sequence; identical to SEQ ID NO: 719
  Description of Artificial Sequence: Synthetic polynucleotide

SEQ ID NO: 872 - protein, 272 aa, Artificial Sequence; identical to SEQ ID NO: 720
  Description of Artificial Sequence: Synthetic polypeptide

SEQ ID NO: 873 - DNA, 837 bp, Artificial Sequence; identical to SEQ ID NO: 721
  Description of Artificial Sequence: Synthetic polynucleotide

SEQ ID NO: 874 - protein, 279 aa, Artificial Sequence; identical to SEQ ID NO: 722
  Description of Artificial Sequence: Synthetic polypeptide

SEQ ID NO: 875 - DNA, 825 bp, Artificial Sequence; identical to SEQ ID NO: 723
  Description of Artificial Sequence: Synthetic polynucleotide

SEQ ID NO: 876 - protein, 275 aa, Artificial Sequence; identical to SEQ ID NO: 724
  Description of Artificial Sequence: Synthetic polypeptide

SEQ ID NO: 877 - DNA, 834 bp, Artificial Sequence; identical to SEQ ID NO: 725
  Description of Artificial Sequence: Synthetic polynucleotide

SEQ ID NO: 878 - protein, 278 aa, Artificial Sequence; identical to SEQ ID NO: 726
  Description of Artificial Sequence: Synthetic polypeptide

SEQ ID NO: 879 - DNA, 843 bp, Artificial Sequence; identical to SEQ ID NO: 727
  Description of Artificial Sequence: Synthetic polynucleotide

SEQ ID NO: 880 - protein, 281 aa, Artificial Sequence; identical to SEQ ID NO: 728
  Description of Artificial Sequence: Synthetic polypeptide

SEQ ID NO: 881 - DNA, 819 bp, Artificial Sequence; identical to SEQ ID NO: 729
  Description of Artificial Sequence: Synthetic polynucleotide

SEQ ID NO: 882 - protein, 273 aa, Artificial Sequence; identical to SEQ ID NO: 730
  Description of Artificial Sequence: Synthetic polypeptide

SEQ ID NO: 883 - DNA, 852 bp, Artificial Sequence; identical to SEQ ID NO: 731
  Description of Artificial Sequence: Synthetic polynucleotide

SEQ ID NO: 884 - protein, 284 aa, Artificial Sequence; identical to SEQ ID NO: 732
  Description of Artificial Sequence: Synthetic polypeptide

SEQ ID NO: 885 - DNA, 855 bp, Artificial Sequence; identical to SEQ ID NO: 733
  Description of Artificial Sequence: Synthetic polynucleotide

SEQ ID NO: 886 - protein, 285 aa, Artificial Sequence; identical to SEQ ID NO: 734
  Description of Artificial Sequence: Synthetic polypeptide

SEQ ID NO: 887 - DNA, 867 bp, Artificial Sequence; identical to SEQ ID NO: 735
  Description of Artificial Sequence: Synthetic polynucleotide

SEQ ID NO: 888 - protein, 289 aa, Artificial Sequence; identical to SEQ ID NO: 736
  Description of Artificial Sequence: Synthetic polypeptide

SEQ ID NO: 889 - DNA, 852 bp, Artificial Sequence; identical to SEQ ID NO: 737
  Description of Artificial Sequence: Synthetic polynucleotide

SEQ ID NO: 890 - protein, 284 aa, Artificial Sequence; identical to SEQ ID NO: 738
  Description of Artificial Sequence: Synthetic polypeptide

SEQ ID NO: 891 - DNA, 831 bp, Artificial Sequence; identical to SEQ ID NO: 739
  Description of Artificial Sequence: Synthetic polynucleotide

SEQ ID NO: 892 - protein, 277 aa, Artificial Sequence; identical to SEQ ID NO: 740
  Description of Artificial Sequence: Synthetic polypeptide

SEQ ID NO: 893 - DNA, 819 bp, Artificial Sequence; identical to SEQ ID NO: 741
  Description of Artificial Sequence: Synthetic polynucleotide

SEQ ID NO: 894 - protein, 273 aa, Artificial Sequence; identical to SEQ ID NO: 742
  Description of Artificial Sequence: Synthetic polypeptide

SEQ ID NO: 895 - DNA, 834 bp, Artificial Sequence; identical to SEQ ID NO: 743
  Description of Artificial Sequence: Synthetic polynucleotide

SEQ ID NO: 896 - protein, 278 aa, Artificial Sequence; identical to SEQ ID NO: 744
  Description of Artificial Sequence: Synthetic polypeptide

SEQ ID NO: 897 - protein, 15 aa, Artificial Sequence
  Description of Artificial Sequence: Synthetic peptide
GGGGSGGGGSGGGGS

SEQ ID NO: 898 - DNA, 45 bp, Artificial Sequence
  Description of Artificial Sequence: Synthetic oligonucleotide
ggtggaggtggatcaggtggaggtggatctggtggaggtggatct

SEQ ID NO: 899 - protein, 977 aa, Homo sapiens [sequence omitted]

SEQ ID NO: 900 - protein, 87 aa, Homo sapiens
RPVLTLRAPGTHAAVGDLLELHCEALRGSPLILYRFFHEDVTLGNRSSPSGGASLNLSLTAEHSGNYSCEADNGLGAQRSETVTLYI

SEQ ID NO: 901 - protein, 5 aa, Artificial Sequence
  Description of Artificial Sequence: Synthetic peptide
GGGGS

SEQ ID NO: 902 - protein, 7 aa, Artificial Sequence
  Description of Artificial Sequence: Synthetic peptide
SGGSGGS

SEQ ID NO: 903 - protein, 9 aa, Artificial Sequence
  Description of Artificial Sequence: Synthetic peptide
GGGGSGGGS

SEQ ID NO: 904 - protein, 10 aa, Artificial Sequence
  Description of Artificial Sequence: Synthetic peptide
GGGGSGGGGS

SEQ ID NO: 905 - protein, 18 aa, Artificial Sequence
  Description of Artificial Sequence: Synthetic peptide
GGGGSGGGGSGGGGGGGS

SEQ ID NO: 906 - protein, 20 aa, Artificial Sequence
  Description of Artificial Sequence: Synthetic peptide
GGGGSGGGGSGGGGSGGGGS

SEQ ID NO: 907 - protein, 25 aa, Artificial Sequence
  Description of Artificial Sequence: Synthetic peptide
GGGGSGGGGSGGGGSGGGGSGGGGS

SEQ ID NO: 908 - protein, 30 aa, Artificial Sequence
  Description of Artificial Sequence: Synthetic polypeptide
GGGGSGGGGSGGGGSGGGGSGGGGSGGGGS

SEQ ID NO: 909 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 910 - protein, 15 aa, Artificial Sequence
  Description of Artificial Sequence: Synthetic peptide
EPKSCDKTHTCPPCP

SEQ ID NO: 911 - protein, 24 aa, Artificial Sequence
  Description of Artificial Sequence: Synthetic peptide
GGGGSGGGSEPKSCDKTHTCPPCP

SEQ ID NO: 912 - protein, 62 aa, Artificial Sequence
  Description of Artificial Sequence: Synthetic polypeptide
ELKTPLGDTTHTCPRCPEPKSCDTPPPCPRCPEPKSCDTPPPCPRCPEPKSCDTPPPCPRCP

SEQ ID NO: 913 - protein, 6 aa, Artificial Sequence
  Description of Artificial Sequence: Synthetic peptide
GSGSGS

SEQ ID NO: 914 - protein, 3 aa, Artificial Sequence
  Description of Artificial Sequence: Synthetic peptide
AAA

SEQ ID NO: 915 - protein, 12 aa, Homo sapiens
RSETVTLYITGL

SEQ ID NO: 916 - protein, 11 aa, Homo sapiens
SRPILTFRAPR

SEQ ID NO: 917 - protein, 78 aa, Homo sapiens
GTHAAVGDLLELHCEALRGSPLILYRFFHEDVTLGNRSSPSGGASLNLSLTAEHSGNYSCEADNGLGAQRSETVTLYI

SEQ ID NO: 918 - protein, 33 aa, Artificial Sequence
  Description of Artificial Sequence: Synthetic polypeptide
CLSSERERVEDLFEYECELLTSEPIFHCRQEDC

SEQ ID NO: 919 - protein, 11 aa, Homo sapiens
LRGSPLILYRF

SEQ ID NO: 920 - protein, 11 aa, Homo sapiens
LRGSSPILYWF

SEQ ID NO: 921 - protein, 11 aa, Homo sapiens
APRGSPPILYW

SEQ ID NO: 922 - protein, 907 aa, Artificial Sequence
  Description of Artificial Sequence: Synthetic polypeptide
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSIISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAAAAEQKLISEEDLEQKLISEEDLEQKLISEEDLTGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 923 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSIISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGPEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 924 - protein, 33 aa, Artificial Sequence
  Description of Artificial Sequence: Synthetic polypeptide
CMDYDFKVKLSSERERCWAIGCIFAELLTSEPC

SEQ ID NO: 925 - protein, 33 aa, Artificial Sequence
  Description of Artificial Sequence: Synthetic polypeptide
CMDYDFKVKLSSERERCCIFAELLTSEPIFHCC

SEQ ID NO: 926 - protein, 33 aa, Artificial Sequence
  Description of Artificial Sequence: Synthetic polypeptide
CMDYDFKVKLSSERERCELLTSEPIFHCRQEDC

SEQ ID NO: 927 - protein, 33 aa, Artificial Sequence
  Description of Artificial Sequence: Synthetic polypeptide
CMDYDFKVKLSSERERCSEPIFHCRQEDIKTSC

SEQ ID NO: 928 - protein, 33 aa, Artificial Sequence
  Description of Artificial Sequence: Synthetic polypeptide
CFKVKLSSERERVEDLCWAIGCIFAELLTSEPC

SEQ ID NO: 929 - protein, 33 aa, Artificial Sequence
  Description of Artificial Sequence: Synthetic polypeptide
CFKVKLSSERERVEDLCCIFAELLTSEPIFHCC

SEQ ID NO: 930 - protein, 33 aa, Artificial Sequence
  Description of Artificial Sequence: Synthetic polypeptide
CFKVKLSSERERVEDLCELLTSEPIFHCRQEDC

SEQ ID NO: 931 - protein, 33 aa, Artificial Sequence
  Description of Artificial Sequence: Synthetic polypeptide
CFKVKLSSERERVEDLCSEPIFHCRQEDIKTSC

SEQ ID NO: 932 - protein, 33 aa, Artificial Sequence
  Description of Artificial Sequence: Synthetic polypeptide
CLSSERERVEDLFEYECWAIGCIFAELLTSEPC

SEQ ID NO: 933 - protein, 33 aa, Artificial Sequence
  Description of Artificial Sequence: Synthetic polypeptide
CLSSERERVEDLFEYECCIFAELLTSEPIFHCC

SEQ ID NO: 934 - protein, 33 aa, Artificial Sequence
  Description of Artificial Sequence: Synthetic polypeptide
CLSSERERVEDLFEYECSEPIFHCRQEDIKTSC

SEQ ID NO: 935 - protein, 33 aa, Artificial Sequence
  Description of Artificial Sequence: Synthetic polypeptide
CRERVEDLFEYEGCKVCWAIGCIFAELLTSEPC

SEQ ID NO: 936 - protein, 33 aa, Artificial Sequence
  Description of Artificial Sequence: Synthetic polypeptide
CRERVEDLFEYEGCKVCCIFAELLTSEPIFHCC

SEQ ID NO: 937 - protein, 33 aa, Artificial Sequence
  Description of Artificial Sequence: Synthetic polypeptide
CRERVEDLFEYEGCKVCELLTSEPIFHCRQEDC

SEQ ID NO: 938 - protein, 33 aa, Artificial Sequence
  Description of Artificial Sequence: Synthetic polypeptide
CRERVEDLFEYEGCKVCSEPIFHCRQEDIKTSC

SEQ ID NO: 939 - protein, 15 aa, Artificial Sequence
  Description of Artificial Sequence: Synthetic peptide
MDYDFKVKLSSERER

SEQ ID NO: 940 - protein, 15 aa, Artificial Sequence
  Description of Artificial Sequence: Synthetic peptide
FKVKLSSERERVEDL

SEQ ID NO: 941 - protein, 15 aa, Artificial Sequence
  Description of Artificial Sequence: Synthetic peptide
LSSERERVEDLFEYE

SEQ ID NO: 942 - protein, 15 aa, Artificial Sequence
  Description of Artificial Sequence: Synthetic peptide
RERVEDLFEYEGCKV

SEQ ID NO: 943 - protein, 15 aa, Artificial Sequence
  Description of Artificial Sequence: Synthetic peptide
WAIGCIFAELLTSEP

SEQ ID NO: 944 - protein, 15 aa, Artificial Sequence
  Description of Artificial Sequence: Synthetic peptide
CIFAELLTSEPIFHC

SEQ ID NO: 945 - protein, 15 aa, Artificial Sequence
  Description of Artificial Sequence: Synthetic peptide
ELLTSEPIFHCRQED

SEQ ID NO: 946 - protein, 15 aa, Artificial Sequence
  Description of Artificial Sequence: Synthetic peptide
SEPIFHCRQEDIKTS

SEQ ID NO: 947 - protein, 10 aa, Artificial Sequence
  Description of Artificial Sequence: Synthetic peptide
ARNNHYYNDY

What is claimed is:

1. An anti-Fc Receptor-Like 5 (FcRL5) antibody or an antigen-binding fragment thereof comprising:
   (aa) a light chain variable region comprising a CDR1, a CDR2, and a CDR3 sequence set forth in SEQ ID NOs: 312, 313, and 314, respectively, and a heavy chain variable region comprising a CDR1, a CDR2, and a CDR3 sequence set forth in SEQ ID NOs: 309, 310, and 311, respectively;
   (ab) a light chain variable region comprising a CDR1, a CDR2, and a CDR3 sequence set forth in SEQ ID NOs: 318, 319, and 320, respectively, and a heavy chain variable region comprising a CDR1, a CDR2, and a CDR3 sequence set forth in SEQ ID NOs: 315, 316, and 317, respectively;
   (ac) a light chain variable region comprising a CDR1, a CDR2, and a CDR3 sequence set forth in SEQ ID NOs: 324, 319, and 325, respectively, and a heavy chain variable region comprising a CDR1, a CDR2, and a CDR3 sequence set forth in SEQ ID NOs: 321, 322, and 323, respectively;

(ad) a light chain variable region comprising a CDR1, a CDR2, and a CDR3 sequence set forth in SEQ ID NOs: 329, 330, and 331, respectively, and a heavy chain variable region comprising a CDR1, a CDR2, and a CDR3 sequence set forth in SEQ ID NOs: 326, 327, and 328, respectively;

(ae) a light chain variable region comprising a CDR1, a CDR2, and a CDR3 sequence set forth in SEQ ID NOs: 329, 330, and 331, respectively, and a heavy chain variable region comprising a CDR1, a CDR2, and a CDR3 sequence set forth in SEQ ID NOs: 332, 333, and 334, respectively;

(af) a light chain variable region comprising a CDR1, a CDR2, and a CDR3 sequence set forth in SEQ ID NOs: 338, 330, and 339, respectively, and a heavy chain variable region comprising a CDR1, a CDR2, and a CDR3 sequence set forth in SEQ ID NOs: 335, 336, and 337, respectively;

(ag) a light chain variable region comprising a CDR1, a CDR2, and a CDR3 sequence set forth in SEQ ID NOs: 343, 344, and 345, respectively, and a heavy chain variable region comprising a CDR1, a CDR2, and a CDR3 sequence set forth in SEQ ID NOs: 340, 341, and 342, respectively;

(ah) a light chain variable region comprising a CDR1, a CDR2, and a CDR3 sequence set forth in SEQ ID NOs: 348, 349, and 350, respectively, and a heavy chain variable region comprising a CDR1, a CDR2, and a CDR3 sequence set forth in SEQ ID NOs: 346, 327, and 347, respectively;

(ai) a light chain variable region comprising a CDR1, a CDR2, and a CDR3 sequence set forth in SEQ ID NOs: 352, 344, and 353, respectively, and a heavy chain variable region comprising a CDR1, a CDR2, and a CDR3 sequence set forth in SEQ ID NOs: 346, 327, and 351, respectively;

(aj) a light chain variable region comprising a CDR1, a CDR2, and a CDR3 sequence set forth in SEQ ID NOs: 357, 358, and 359, respectively, and a heavy chain variable region comprising a CDR1, a CDR2, and a CDR3 sequence set forth in SEQ ID NOs: 354, 355, and 356, respectively;

(ak) a light chain variable region comprising a CDR1, a CDR2, and a CDR3 sequence set forth in SEQ ID NOs: 363, 364, and 365, respectively, and a heavy chain variable region comprising a CDR1, a CDR2, and a CDR3 sequence set forth in SEQ ID NOs: 360, 361, and 362, respectively;

(al) a light chain variable region comprising a CDR1, a CDR2, and a CDR3 sequence set forth in SEQ ID NOs: 369, 370, and 371, respectively, and a heavy chain variable region comprising a CDR1, a CDR2, and a CDR3 sequence set forth in SEQ ID NOs: 366, 367, and 368, respectively;

(am) a light chain variable region comprising a CDR1, a CDR2, and a CDR3 sequence set forth in SEQ ID NOs: 329, 330, and 375, respectively, and a heavy chain variable region comprising a CDR1, a CDR2, and a CDR3 sequence set forth in SEQ ID NOs: 372, 373, and 374, respectively;

(an) a light chain variable region comprising a CDR1, a CDR2, and a CDR3 sequence set forth in SEQ ID NOs: 329, 330, and 377, respectively, and a heavy chain variable region comprising a CDR1, a CDR2, and a CDR3 sequence set forth in SEQ ID NOs: 346, 327, and 376, respectively;

(ao) a light chain variable region comprising a CDR1, a CDR2, and a CDR3 sequence set forth in SEQ ID NOs: 381, 382, and 383, respectively, and a heavy chain variable region comprising a CDR1, a CDR2, and a CDR3 sequence set forth in SEQ ID NOs: 378, 379, and 380, respectively;

(ap) a light chain variable region comprising a CDR1, a CDR2, and a CDR3 sequence set forth in SEQ ID NOs: 329, 385, and 386, respectively, and a heavy chain variable region comprising a CDR1, a CDR2, and a CDR3 sequence set forth in SEQ ID NOs: 309, 310, and 384, respectively;

(aq) a light chain variable region comprising a CDR1, a CDR2, and a CDR3 sequence set forth in SEQ ID NOs: 390, 391, and 392, respectively, and a heavy chain variable region comprising a CDR1, a CDR2, and a CDR3 sequence set forth in SEQ ID NOs: 387, 388, and 389, respectively;

(ar) a light chain variable region comprising a CDR1, a CDR2, and a CDR3 sequence set forth in SEQ ID NOs: 318, 319, and 395, respectively, and a heavy chain variable region comprising a CDR1, a CDR2, and a CDR3 sequence set forth in SEQ ID NOs: 393, 355, and 394, respectively;

(as) a light chain variable region comprising a CDR1, a CDR2, and a CDR3 sequence set forth in SEQ ID NOs: 397, 398, and 399, respectively, and a heavy chain variable region comprising a CDR1, a CDR2, and a CDR3 sequence set forth in SEQ ID NOs: 346, 327, and 396, respectively;

(at) a light chain variable region comprising a CDR1, a CDR2, and a CDR3 sequence set forth in SEQ ID NOs: 401, 398, and 402, respectively, and a heavy chain variable region comprising a CDR1, a CDR2, and a CDR3 sequence set forth in SEQ ID NOs: 346, 327, and 400, respectively;

(au) a light chain variable region comprising a CDR1, a CDR2, and a CDR3 sequence set forth in SEQ ID NOs: 406, 398, and 407, respectively, and a heavy chain variable region comprising a CDR1, a CDR2, and a CDR3 sequence set forth in SEQ ID NOs: 403, 404, and 405, respectively;

(av) a light chain variable region comprising a CDR1, a CDR2, and a CDR3 sequence set forth in SEQ ID NOs: 329, 409, and 410, respectively, and a heavy chain variable region comprising a CDR1, a CDR2, and a CDR3 sequence set forth in SEQ ID NOs: 346, 327, and 408, respectively;

(aw) a light chain variable region comprising a CDR1, a CDR2, and a CDR3 sequence set forth in SEQ ID NOs: 318, 319, and 414, respectively, and a heavy chain variable region comprising a CDR1, a CDR2, and a CDR3 sequence set forth in SEQ ID NOs: 411, 412, and 413, respectively;

(ax) a light chain variable region comprising a CDR1, a CDR2, and a CDR3 sequence set forth in SEQ ID NOs: 416, 417, and 418, respectively, and a heavy chain variable region comprising a CDR1, a CDR2, and a CDR3 sequence set forth in SEQ ID NOs: 411, 412, and 415, respectively;

(ay) a light chain variable region comprising a CDR1, a CDR2, and a CDR3 sequence set forth in SEQ ID NOs: 318, 319, and 419, respectively, and a heavy chain variable region comprising a CDR1, a CDR2, and a CDR3 sequence set forth in SEQ ID NOs: 411, 412, and 349, respectively;

(az) a light chain variable region comprising a CDR1, a CDR2, and a CDR3 sequence set forth in SEQ ID NOs: 423, 358, and 424, respectively, and a heavy chain variable region comprising a CDR1, a CDR2, and a CDR3 sequence set forth in SEQ ID NOs: 420, 421, and 422, respectively;

(ba) a light chain variable region comprising a CDR1, a CDR2, and a CDR3 sequence set forth in SEQ ID NOs: 428, 429, and 430, respectively, and a heavy chain variable region comprising a CDR1, a CDR2, and a CDR3 sequence set forth in SEQ ID NOs: 425, 426, and 427, respectively;

(bb) a light chain variable region comprising a CDR1, a CDR2, and a CDR3 sequence set forth in SEQ ID NOs: 433, 434, and 435, respectively, and a heavy chain variable region comprising a CDR1, a CDR2, and a CDR3 sequence set forth in SEQ ID NOs: 372, 431, and 432, respectively;

(bc) a light chain variable region comprising a CDR1, a CDR2, and a CDR3 sequence set forth in SEQ ID NOs: 423, 438, and 439, respectively, and a heavy chain variable region comprising a CDR1, a CDR2, and a CDR3 sequence set forth in SEQ ID NOs: 436, 388, and 437, respectively;

(bd) a light chain variable region comprising a CDR1, a CDR2, and a CDR3 sequence set forth in SEQ ID NOs: 329, 330, and 443, respectively, and a heavy chain variable region comprising a CDR1, a CDR2, and a CDR3 sequence set forth in SEQ ID NOs: 440, 441, and 442, respectively;

(be) a light chain variable region comprising a CDR1, a CDR2, and a CDR3 sequence set forth in SEQ ID NOs: 447, 448, and 449, respectively, and a heavy chain variable region comprising a CDR1, a CDR2, and a CDR3 sequence set forth in SEQ ID NOs: 444, 445, and 446, respectively;

(bf) a light chain variable region comprising a CDR1, a CDR2, and a CDR3 sequence set forth in SEQ ID NOs: 318, 319, and 452, respectively, and a heavy chain variable region comprising a CDR1, a CDR2, and a CDR3 sequence set forth in SEQ ID NOs: 309, 450, and 451, respectively;

(bg) a light chain variable region comprising a CDR1, a CDR2, and a CDR3 sequence set forth in SEQ ID NOs: 369, 454, and 455, respectively, and a heavy chain variable region comprising a CDR1, a CDR2, and a CDR3 sequence set forth in SEQ ID NOs: 411, 412, and 453, respectively;

(bh) a light chain variable region comprising a CDR1, a CDR2, and a CDR3 sequence set forth in SEQ ID NOs: 318, 319, and 457, respectively, and a heavy chain variable region comprising a CDR1, a CDR2, and a CDR3 sequence set forth in SEQ ID NOs: 411, 412, and 456, respectively;

(bi) a light chain variable region comprising a CDR1, a CDR2, and a CDR3 sequence set forth in SEQ ID NOs: 329, 330, and 331, respectively, and a heavy chain variable region comprising a CDR1, a CDR2, and a CDR3 sequence set forth in SEQ ID NOs: 346, 327, and 458, respectively;

(bj) a light chain variable region comprising a CDR1, a CDR2, and a CDR3 sequence set forth in SEQ ID NOs: 460, 461, and 462, respectively, and a heavy chain variable region comprising a CDR1, a CDR2, and a CDR3 sequence set forth in SEQ ID NOs: 411, 412, and 459, respectively;

(bk) a light chain variable region comprising a CDR1, a CDR2, and a CDR3 sequence set forth in SEQ ID NOs: 318, 319, and 419, respectively, and a heavy chain variable region comprising a CDR1, a CDR2, and a CDR3 sequence set forth in SEQ ID NOs: 411, 412, and 463, respectively;

(bl) a light chain variable region comprising a CDR1, a CDR2, and a CDR3 sequence set forth in SEQ ID NOs: 423, 438, and 465, respectively, and a heavy chain variable region comprising a CDR1, a CDR2, and a CDR3 sequence set forth in SEQ ID NOs: 436, 388, and 464, respectively;

(bm) a light chain variable region comprising a CDR1, a CDR2, and a CDR3 sequence set forth in SEQ ID NOs: 468, 469, and 470, respectively, and a heavy chain variable region comprising a CDR1, a CDR2, and a CDR3 sequence set forth in SEQ ID NOs: 411, 466, and 467, respectively;

(bn) a light chain variable region comprising a CDR1, a CDR2, and a CDR3 sequence set forth in SEQ ID NOs: 474, 358, and 465, respectively, and a heavy chain variable region comprising a CDR1, a CDR2, and a CDR3 sequence set forth in SEQ ID NOs: 471, 472, and 473, respectively;

(bo) a light chain variable region comprising a CDR1, a CDR2, and a CDR3 sequence set forth in SEQ ID NOs: 477, 478, and 479, respectively, and a heavy chain variable region comprising a CDR1, a CDR2, and a CDR3 sequence set forth in SEQ ID NOs: 372, 475, and 476, respectively;

(bp) a light chain variable region comprising a CDR1, a CDR2, and a CDR3 sequence set forth in SEQ ID NOs: 483, 484, and 485, respectively, and a heavy chain variable region comprising a CDR1, a CDR2, and a CDR3 sequence set forth in SEQ ID NOs: 480, 481, and 482, respectively;

(bq) a light chain variable region comprising a CDR1, a CDR2, and a CDR3 sequence set forth in SEQ ID NOs: 433, 487, and 488, respectively, and a heavy chain variable region comprising a CDR1, a CDR2, and a CDR3 sequence set forth in SEQ ID NOs: 346, 327, and 486, respectively;

(br) a light chain variable region comprising a CDR1, a CDR2, and a CDR3 sequence set forth in SEQ ID NOs: 490, 313, and 491, respectively, and a heavy chain variable region comprising a CDR1, a CDR2, and a CDR3 sequence set forth in SEQ ID NOs: 309, 310, and 489, respectively;

(bs) a light chain variable region comprising a CDR1, a CDR2, and a CDR3 sequence set forth in SEQ ID NOs: 312, 313, and 493, respectively, and a heavy chain variable region comprising a CDR1, a CDR2, and a CDR3 sequence set forth in SEQ ID NOs: 309, 310, and 492, respectively;

(bt) a light chain variable region comprising a CDR1, a CDR2, and a CDR3 sequence set forth in SEQ ID NOs: 490, 349, and 495, respectively, and a heavy chain variable region comprising a CDR1, a CDR2, and a CDR3 sequence set forth in SEQ ID NOs: 403, 404, and 494, respectively;

(bu) a light chain variable region comprising a CDR1, a CDR2, and a CDR3 sequence set forth in SEQ ID NOs: 498, 344, and 499, respectively, and a heavy chain variable region comprising a CDR1, a CDR2, and a CDR3 sequence set forth in SEQ ID NOs: 403, 496, and 497, respectively;

(bv) a light chain variable region comprising a CDR1, a CDR2, and a CDR3 sequence set forth in SEQ ID NOs: 503, 504, and 505, respectively, and a heavy chain variable region comprising a CDR1, a CDR2, and a CDR3 sequence set forth in SEQ ID NOs: 500, 501, and 502, respectively;

(bw) a light chain variable region comprising a CDR1, a CDR2, and a CDR3 sequence set forth in SEQ ID NOs: 508, 349, and 509, respectively, and a heavy chain variable region comprising a CDR1, a CDR2, and a CDR3 sequence set forth in SEQ ID NOs: 403, 506, and 507, respectively;

(bx) a light chain variable region comprising a CDR1, a CDR2, and a CDR3 sequence set forth in SEQ ID NOs: 312, 513, and 514, respectively, and a heavy chain variable region comprising a CDR1, a CDR2, and a CDR3 sequence set forth in SEQ ID NOs: 510, 511, and 512, respectively;

(by) a light chain variable region comprising a CDR1, a CDR2, and a CDR3 sequence set forth in SEQ ID NOs: 518, 319, and 519, respectively, and a heavy chain variable region comprising a CDR1, a CDR2, and a CDR3 sequence set forth in SEQ ID NOs: 515, 516, and 517, respectively;

(bz) a light chain variable region comprising a CDR1, a CDR2, and a CDR3 sequence set forth in SEQ ID NOs: 348, 523, and 524, respectively, and a heavy chain variable region comprising a CDR1, a CDR2, and a CDR3 sequence set forth in SEQ ID NOs: 520, 521, and 522, respectively;

(ca) a light chain variable region comprising a CDR1, a CDR2, and a CDR3 sequence set forth in SEQ ID NOs: 406, 398, and 528, respectively, and a heavy chain variable region comprising a CDR1, a CDR2, and a CDR3 sequence set forth in SEQ ID NOs: 525, 526, and 527, respectively;

(cb) a light chain variable region comprising a CDR1, a CDR2, and a CDR3 sequence set forth in SEQ ID NOs: 318, 319, and 530, respectively, and a heavy chain variable region comprising a CDR1, a CDR2, and a CDR3 sequence set forth in SEQ ID NOs: 411, 412, and 529, respectively;

(cc) a light chain variable region comprising a CDR1, a CDR2, and a CDR3 sequence set forth in SEQ ID NOs: 318, 319, and 531, respectively, and a heavy chain variable region comprising a CDR1, a CDR2, and a CDR3 sequence set forth in SEQ ID NOs: 515, 516, and 517, respectively;

(cd) a light chain variable region comprising a CDR1, a CDR2, and a CDR3 sequence set forth in SEQ ID NOs: 533, 534, and 535, respectively, and a heavy chain variable region comprising a CDR1, a CDR2, and a CDR3 sequence set forth in SEQ ID NOs: 403, 404, and 532, respectively;

(ce) a light chain variable region comprising a CDR1, a CDR2, and a CDR3 sequence set forth in SEQ ID NOs: 428, 429, and 430, respectively, and a heavy chain variable region comprising a CDR1, a CDR2, and a CDR3 sequence set forth in SEQ ID NOs: 425, 426, and 536, respectively;

(cf) a light chain variable region comprising a CDR1, a CDR2, and a CDR3 sequence set forth in SEQ ID NOs: 540, 398, and 541, respectively, and a heavy chain variable region comprising a CDR1, a CDR2, and a CDR3 sequence set forth in SEQ ID NOs: 537, 538, and 539, respectively;

(cg) a light chain variable region comprising a CDR1, a CDR2, and a CDR3 sequence set forth in SEQ ID NOs: 406, 398, and 542, respectively, and a heavy chain variable region comprising a CDR1, a CDR2, and a CDR3 sequence set forth in SEQ ID NOs: 537, 538, and 539, respectively;

(ch) a light chain variable region comprising a CDR1, a CDR2, and a CDR3 sequence set forth in SEQ ID NOs: 544, 448, and 545, respectively, and a heavy chain variable region comprising a CDR1, a CDR2, and a CDR3 sequence set forth in SEQ ID NOs: 411, 412, and 543, respectively;

(ci) a light chain variable region comprising a CDR1, a CDR2, and a CDR3 sequence set forth in SEQ ID NOs: 547, 548, and 549, respectively, and a heavy chain variable region comprising a CDR1, a CDR2, and a CDR3 sequence set forth in SEQ ID NOs: 411, 412, and 546, respectively;

(cj) a light chain variable region comprising a CDR1, a CDR2, and a CDR3 sequence set forth in SEQ ID NOs: 312, 313, and 314, respectively, and a heavy chain variable region comprising a CDR1, a CDR2, and a CDR3 sequence set forth in SEQ ID NOs: 309, 310, and 550, respectively;

(ck) a light chain variable region comprising a CDR1, a CDR2, and a CDR3 sequence set forth in SEQ ID NOs: 312, 513, and 314, respectively, and a heavy chain variable region comprising a CDR1, a CDR2, and a CDR3 sequence set forth in SEQ ID NOs: 309, 310, and 550, respectively;

(cl) a light chain variable region comprising a CDR1, a CDR2, and a CDR3 sequence set forth in SEQ ID NOs: 406, 398, and 554, respectively, and a heavy chain variable region comprising a CDR1, a CDR2, and a CDR3 sequence set forth in SEQ ID NOs: 551, 552, and 553, respectively;

(cm) a light chain variable region comprising a CDR1, a CDR2, and a CDR3 sequence set forth in SEQ ID NOs: 556, 557, and 558, respectively, and a heavy chain variable region comprising a CDR1, a CDR2, and a CDR3 sequence set forth in SEQ ID NOs: 309, 310, and 555, respectively;

(cn) a light chain variable region comprising a CDR1, a CDR2, and a CDR3 sequence set forth in SEQ ID NOs: 562, 563, and 564, respectively, and a heavy chain variable region comprising a CDR1, a CDR2, and a CDR3 sequence set forth in SEQ ID NOs: 559, 560, and 561, respectively;

(co) a light chain variable region comprising a CDR1, a CDR2, and a CDR3 sequence set forth in SEQ ID NOs: 568, 504, and 569, respectively, and a heavy chain variable region comprising a CDR1, a CDR2, and a CDR3 sequence set forth in SEQ ID NOs: 565, 566, and 567, respectively;

(cp) a light chain variable region comprising a CDR1, a CDR2, and a CDR3 sequence set forth in SEQ ID NOs: 571, 572, and 573, respectively, and a heavy chain variable region comprising a CDR1, a CDR2, and a CDR3 sequence set forth in SEQ ID NOs: 372, 475, and 570, respectively;

(cq) a light chain variable region comprising a CDR1, a CDR2, and a CDR3 sequence set forth in SEQ ID NOs: 343, 575, and 576, respectively, and a heavy chain variable region comprising a CDR1, a CDR2, and a CDR3 sequence set forth in SEQ ID NOs: 403, 404, and 574, respectively;

(cr) a light chain variable region comprising a CDR1, a CDR2, and a CDR3 sequence set forth in SEQ ID NOs: 312, 313, and 314, respectively, and a heavy chain variable region comprising a CDR1, a CDR2, and a CDR3 sequence set forth in SEQ ID NOs: 411, 412, and 577, respectively;
(cs) a light chain variable region comprising a CDR1, a CDR2, and a CDR3 sequence set forth in SEQ ID NOs: 312, 313, and 314, respectively, and a heavy chain variable region comprising a CDR1, a CDR2, and a CDR3 sequence set forth in SEQ ID NOs: 346, 327, and 578, respectively;
(ct) a light chain variable region comprising a CDR1, a CDR2, and a CDR3 sequence set forth in SEQ ID NOs: 580, 438, and 581, respectively, and a heavy chain variable region comprising a CDR1, a CDR2, and a CDR3 sequence set forth in SEQ ID NOs: 436, 388, and 579, respectively;
(cu) a light chain variable region comprising a CDR1, a CDR2, and a CDR3 sequence set forth in SEQ ID NOs: 585, 313, and 314, respectively, and a heavy chain variable region comprising a CDR1, a CDR2, and a CDR3 sequence set forth in SEQ ID NOs: 582, 583, and 584, respectively;
(cv) a light chain variable region comprising a CDR1, a CDR2, and a CDR3 sequence set forth in SEQ ID NOs: 312, 586, and 314, respectively, and a heavy chain variable region comprising a CDR1, a CDR2, and a CDR3 sequence set forth in SEQ ID NOs: 346, 327, and 578, respectively;
(cw) a light chain variable region comprising a CDR1, a CDR2, and a CDR3 sequence set forth in SEQ ID NOs: 588, 385, and 375, respectively, and a heavy chain variable region comprising a CDR1, a CDR2, and a CDR3 sequence set forth in SEQ ID NOs: 403, 404, and 587, respectively; or
(cx) a light chain variable region comprising a CDR1, a CDR2, and a CDR3 sequence set forth in SEQ ID NOs: 318, 319, and 592, respectively, and a heavy chain variable region comprising a CDR1, a CDR2, and a CDR3 sequence set forth in SEQ ID NOs: 589, 590, and 591, respectively.

2. The antibody or antigen-binding fragment thereof of claim 1, wherein:
(aa) the light chain variable region comprises the amino acid sequence set forth in SEQ ID NO:3, and the heavy chain variable region comprises the amino acid sequence set forth in SEQ ID NO:4;
(ab) the light chain variable region comprises the amino acid sequence set forth in SEQ ID NO:7, and the heavy chain variable region comprises the amino acid sequence set forth in SEQ ID NO:8;
(ac) the light chain variable region comprises the amino acid sequence set forth in SEQ ID NO:11, and the heavy chain variable region comprises the amino acid sequence set forth in SEQ ID NO:12;
(ad) the light chain variable region comprises the amino acid sequence set forth in SEQ ID NO:299, and the heavy chain variable region comprises the amino acid sequence set forth in SEQ ID NO:300;
(ae) the light chain variable region comprises the amino acid sequence set forth in SEQ ID NO:15, and the heavy chain variable region comprises the amino acid sequence set forth in SEQ ID NO:16;
(af) the light chain variable region comprises the amino acid sequence set forth in SEQ ID NO:19, and the heavy chain variable region comprises the amino acid sequence set forth in SEQ ID NO:20;
(ag) the light chain variable region comprises the amino acid sequence set forth in SEQ ID NO:23, and the heavy chain variable region comprises the amino acid sequence set forth in SEQ ID NO:24;
(ah) the light chain variable region comprises the amino acid sequence set forth in SEQ ID NO:27, and the heavy chain variable region comprises the amino acid sequence set forth in SEQ ID NO:28;
(ai) the light chain variable region comprises the amino acid sequence set forth in SEQ ID NO:31, and the heavy chain variable region comprises the amino acid sequence set forth in SEQ ID NO:32;
(aj) the light chain variable region comprises the amino acid sequence set forth in SEQ ID NO:35, and the heavy chain variable region comprises the amino acid sequence set forth in SEQ ID NO:36;
(ak) the light chain variable region comprises the amino acid sequence set forth in SEQ ID NO:39, and the heavy chain variable region comprises the amino acid sequence set forth in SEQ ID NO:40;
(al) the light chain variable region comprises the amino acid sequence set forth in SEQ ID NO:43, and the heavy chain variable region comprises the amino acid sequence set forth in SEQ ID NO:44;
(am) the light chain variable region comprises the amino acid sequence set forth in SEQ ID NO:47, and the heavy chain variable region comprises the amino acid sequence set forth in SEQ ID NO:48;
(an) the x light chain variable region comprises the amino acid sequence set forth in SEQ ID NO:51, and the heavy chain variable region comprises the amino acid sequence set forth in SEQ ID NO:52;
(ao) the light chain variable region comprises the amino acid sequence set forth in SEQ ID NO:55, and the heavy chain variable region comprises the amino acid sequence set forth in SEQ ID NO:56;
(ap) the light chain variable region comprises the amino acid sequence set forth in SEQ ID NO:59, and the heavy chain variable region comprises the amino acid sequence set forth in SEQ ID NO:60;
(aq) the light chain variable region comprises the amino acid sequence set forth in SEQ ID NO:63, and the heavy chain variable region comprises the amino acid sequence set forth in SEQ ID NO:64;
(ar) the light chain variable region comprises the amino acid sequence set forth in SEQ ID NO:67, and the heavy chain variable region comprises the amino acid sequence set forth in SEQ ID NO:68;
(as) the light chain variable region comprises the amino acid sequence set forth in SEQ ID NO:71, and the heavy chain variable region comprises the amino acid sequence set forth in SEQ ID NO:72;
(at) the light chain variable region comprises the amino acid sequence set forth in SEQ ID NO:75, and the heavy chain variable region comprises the amino acid sequence set forth in SEQ ID NO:76;
(au) the light chain variable region comprises the amino acid sequence set forth in SEQ ID NO:79, and the heavy chain variable region comprises the amino acid sequence set forth in SEQ ID NO:80;
(av) the light chain variable region comprises the amino acid sequence set forth in SEQ ID NO:83, and the heavy chain variable region comprises the amino acid sequence set forth in SEQ ID NO:84;

(aw) the light chain variable region comprises the amino acid sequence set forth in SEQ ID NO:87, and the heavy chain variable region comprises the amino acid sequence set forth in SEQ ID NO:88;
(ax) the light chain variable region comprises the amino acid sequence set forth in SEQ ID NO:91, and the heavy chain variable region comprises the amino acid sequence set forth in SEQ ID NO:92;
(ay) the light chain variable region comprises the amino acid sequence set forth in SEQ ID NO:95, and the heavy chain variable region comprises the amino acid sequence set forth in SEQ ID NO:96;
(az) the light chain variable region comprises the amino acid sequence set forth in SEQ ID NO:99, and the heavy chain variable region comprises the amino acid sequence set forth in SEQ ID NO:100;
(ba) the light chain variable region comprises the amino acid sequence set forth in SEQ ID NO:103, and the heavy chain variable region comprises the amino acid sequence set forth in SEQ ID NO:104;
(bb) the light chain variable region comprises the amino acid sequence set forth in SEQ ID NO:107, and the heavy chain variable region comprises the amino acid sequence set forth in SEQ ID NO:108;
(bc) the light chain variable region comprises the amino acid sequence set forth in SEQ ID NO:111, and the heavy chain variable region comprises the amino acid sequence set forth in SEQ ID NO:112;
(bd) the light chain variable region comprises the amino acid sequence set forth in SEQ ID NO:115, and the heavy chain variable region comprises the amino acid sequence set forth in SEQ ID NO:116;
(be) the light chain variable region comprises the amino acid sequence set forth in SEQ ID NO:119, and the heavy chain variable region comprises the amino acid sequence set forth in SEQ ID NO:120;
(bf) the x light chain variable region comprises the amino acid sequence set forth in SEQ ID NO:123, and the heavy chain variable region comprises the amino acid sequence set forth in SEQ ID NO:124;
(bg) the light chain variable region comprises the amino acid sequence set forth in SEQ ID NO:127, and the heavy chain variable region comprises the amino acid sequence set forth in SEQ ID NO:128;
(bh) the light chain variable region comprises the amino acid sequence set forth in SEQ ID NO:131, and the heavy chain variable region comprises the amino acid sequence set forth in SEQ ID NO:132;
(bi) the light chain variable region comprises the amino acid sequence set forth in SEQ ID NO:135, and the heavy chain variable region comprises the amino acid sequence set forth in SEQ ID NO:136;
(bj) the light chain variable region comprises the amino acid sequence set forth in SEQ ID NO:139, and the heavy chain variable region comprises the amino acid sequence set forth in SEQ ID NO:140;
(bk) the light chain variable region comprises the amino acid sequence set forth in SEQ ID NO:143, and the heavy chain variable region comprises the amino acid sequence set forth in SEQ ID NO:144;
(bl) the light chain variable region comprises the amino acid sequence set forth in SEQ ID NO:147, and the heavy chain variable region comprises the amino acid sequence set forth in SEQ ID NO:148;
(bm) the light chain variable region comprises the amino acid sequence set forth in SEQ ID NO:151, and the heavy chain variable region comprises the amino acid sequence set forth in SEQ ID NO:152;
(bn) the light chain variable region comprises the amino acid sequence set forth in SEQ ID NO:155, and the heavy chain variable region comprises the amino acid sequence set forth in SEQ ID NO:156;
(bo) the light chain variable region comprises the amino acid sequence set forth in SEQ ID NO:159, and the heavy chain variable region comprises the amino acid sequence set forth in SEQ ID NO:160;
(bp) the light chain variable region comprises the amino acid sequence set forth in SEQ ID NO:163, and the heavy chain variable region comprises the amino acid sequence set forth in SEQ ID NO:164;
(bq) the light chain variable region comprises the amino acid sequence set forth in SEQ ID NO:167, and the heavy chain variable region comprises the amino acid sequence set forth in SEQ ID NO:168;
(br) the light chain variable region comprises the amino acid sequence set forth in SEQ ID NO:171, and the heavy chain variable region comprises the amino acid sequence set forth in SEQ ID NO:172;
(bs) the light chain variable region comprises the amino acid sequence set forth in SEQ ID NO:175, and the heavy chain variable region comprises the amino acid sequence set forth in SEQ ID NO:176;
(bt) the light chain variable region comprises the amino acid sequence set forth in SEQ ID NO:179, and the heavy chain variable region comprises the amino acid sequence set forth in SEQ ID NO:180;
(bu) the light chain variable region comprises the amino acid sequence set forth in SEQ ID NO:183, and the heavy chain variable region comprises the amino acid sequence set forth in SEQ ID NO:184;
(bv) the light chain variable region comprises the amino acid sequence set forth in SEQ ID NO:187, and the heavy chain variable region comprises the amino acid sequence set forth in SEQ ID NO:188;
(bw) the light chain variable region comprises the amino acid sequence set forth in SEQ ID NO:191, and the heavy chain variable region comprises the amino acid sequence set forth in SEQ ID NO:192;
(bx) the light chain variable region comprises the amino acid sequence set forth in SEQ ID NO:195, and the heavy chain variable region comprises the amino acid sequence set forth in SEQ ID NO:196;
(by) the light chain variable region comprises the amino acid sequence set forth in SEQ ID NO:199, and (b) the heavy chain variable region comprises the amino acid sequence set forth in SEQ ID NO:200;
(bz) the light chain variable region comprises the amino acid sequence set forth in SEQ ID NO:203, and the heavy chain variable region comprises the amino acid sequence set forth in SEQ ID NO:204;
(ca) the light chain variable region comprises the amino acid sequence set forth in SEQ ID NO:207, and the heavy chain variable region comprises the amino acid sequence set forth in SEQ ID NO:208;
(cb) the light chain variable region comprises the amino acid sequence set forth in SEQ ID NO:211, and the heavy chain variable region comprises the amino acid sequence set forth in SEQ ID NO:212;
(cc) the light chain variable region comprises the amino acid sequence set forth in SEQ ID NO:215, and the heavy chain variable region comprises the amino acid sequence set forth in SEQ ID NO:216;

(cd) the light chain variable region comprises the amino acid sequence set forth in SEQ ID NO:219, and the heavy chain variable region comprises the amino acid sequence set forth in SEQ ID NO:220;
(ce) the light chain variable region comprises the amino acid sequence set forth in SEQ ID NO:223, and the heavy chain variable region comprises the amino acid sequence set forth in SEQ ID NO:224;
(cf) the light chain variable region comprises the amino acid sequence set forth in SEQ ID NO:227, and the heavy chain variable region the amino acid sequence set forth in SEQ ID NO:228;
(cg) the light chain variable region comprises the amino acid sequence set forth in SEQ ID NO:231, and the heavy chain variable region comprises the amino acid sequence set forth in SEQ ID NO:232;
(ch) the light chain variable region comprises the amino acid sequence set forth in SEQ ID NO:235, and the heavy chain variable region comprises the amino acid sequence set forth in SEQ ID NO:236;
(ci) the light chain variable region comprises the amino acid sequence set forth in SEQ ID NO:239, and the heavy chain variable region comprises the amino acid sequence set forth in SEQ ID NO:240;
(cj) the light chain variable region comprises the amino acid sequence set forth in SEQ ID NO:243, and the heavy chain variable region comprises the amino acid sequence set forth in SEQ ID NO:244;
(ck) the light chain variable region comprises the amino acid sequence set forth in SEQ ID NO:247, and the heavy chain variable region comprises the amino acid sequence set forth in SEQ ID NO:248;
(c) the light chain variable region comprises the amino acid sequence set forth in SEQ ID NO:251, and the heavy chain variable region comprises the amino acid sequence set forth in SEQ ID NO:252;
(cm) the light chain variable region comprises the amino acid sequence set forth in SEQ ID NO:255, and the heavy chain variable region comprises the amino acid sequence set forth in SEQ ID NO:256;
(cn) the light chain variable region comprises the amino acid sequence set forth in SEQ ID NO:259, and the heavy chain variable region comprises the amino acid sequence set forth in SEQ ID NO:260;
(co) the light chain variable region comprises the amino acid sequence set forth in SEQ ID NO:263, and the heavy chain variable region comprises the amino acid sequence set forth in SEQ ID NO:264;
(cp) the light chain variable region comprises the amino acid sequence set forth in SEQ ID NO:267, and the heavy chain variable region comprises the amino acid sequence set forth in SEQ ID NO:268;
(cq) the light chain variable region comprises the amino acid sequence set forth in SEQ ID NO:271, and the heavy chain variable region comprises the amino acid sequence set forth in SEQ ID NO:272;
(cr) the light chain variable region comprises the amino acid sequence set forth in SEQ ID NO:275, and the heavy chain variable region comprises the amino acid sequence set forth in SEQ ID NO:276;
(cs) the light chain variable region comprises the amino acid sequence set forth in SEQ ID NO:279, and the heavy chain variable region comprises the amino acid sequence set forth in SEQ ID NO:280;
(ct) the light chain variable region comprises the amino acid sequence set forth in SEQ ID NO:283, and the heavy chain variable region comprises the amino acid sequence set forth in SEQ ID NO:284;
(cu) the light chain variable region comprises the amino acid sequence set forth in SEQ ID NO:287, and the heavy chain variable region comprises the amino acid sequence set forth in SEQ ID NO:288;
(cv) the light chain variable region comprises the amino acid sequence set forth in SEQ ID NO:291, and the heavy chain variable region comprises the amino acid sequence set forth in SEQ ID NO:292;
(cw) the light chain variable region comprises the amino acid sequence set forth in SEQ ID NO:303, and the heavy chain variable region comprises the amino acid sequence set forth in SEQ ID NO:304; or
(cx) the light chain variable region comprises the amino acid sequence set forth in SEQ ID NO:295, and the heavy chain variable region comprises the amino acid sequence set forth in SEQ ID NO:296.

3. The antibody or antigen-binding fragment thereof of claim 1, wherein the heavy chain variable region comprises a CDR1, a CDR2, and a CDR3 sequence set forth in SEQ ID NO:411, SEQ ID NO:412, and SEQ ID NO:463, respectively; and the light chain variable region comprises a CDR1, a CDR2, and a CDR3 sequence set forth in SEQ ID NO:318, SEQ ID NO:319, and SEQ ID NO:419, respectively.

4. The antibody or antigen-binding fragment thereof of claim 1, wherein the heavy chain variable region comprises a CDR1, a CDR2, and a CDR3 sequence set forth in SEQ ID NO:515, SEQ ID NO:516, and SEQ ID NO:517, respectively; and the light chain variable region comprises a CDR1, a CDR2, and a CDR3 sequence set forth in SEQ ID NO:318, SEQ ID NO:319, and SEQ ID NO:531, respectively.

5. The antibody or antigen-binding fragment thereof of claim 1, wherein the heavy chain variable region comprises a CDR1, a CDR2, and a CDR3 sequence set forth in SEQ ID NO:403, SEQ ID NO:404, and SEQ ID NO:532, respectively; and the light chain variable region comprises a CDR1, a CDR2, and a CDR3 sequence set forth in SEQ ID NO:533, SEQ ID NO:534, and SEQ ID NO:535, respectively.

6. The antibody or antigen-binding fragment thereof of claim 1, wherein the heavy chain variable region comprises a CDR1, a CDR2, and a CDR3 sequence set forth in SEQ ID NO:411, SEQ ID NO:412, and SEQ ID NO:543, respectively; and the light chain variable region comprises a CDR1, a CDR2, and a CDR3 sequence set forth in SEQ ID NO:544, SEQ ID NO:448, and SEQ ID NO:545, respectively.

7. The antibody or antigen-binding fragment thereof of claim 1, wherein the heavy chain variable region comprises a CDR1, a CDR2, and a CDR3 sequence set forth in SEQ ID NO:372, SEQ ID NO:475, and SEQ ID NO:570, respectively; and the light chain variable region comprises a CDR1, a CDR2, and a CDR3 sequence set forth in SEQ ID NO:571, SEQ ID NO:572, and SEQ ID NO:573, respectively.

8. The antibody or antigen-binding fragment thereof of claim 1, wherein the heavy chain variable region comprises a CDR1, a CDR2, and a CDR3 sequence set forth in SEQ ID NO:440, SEQ ID NO:441, and SEQ ID NO:442, respectively; and the light chain variable region comprises a CDR1, a CDR2, and a CDR3 sequence set forth in SEQ ID NO:329, SEQ ID NO:330, and SEQ ID NO:443, respectively.

9. The antibody or antigen-binding fragment thereof of claim 1, wherein the heavy chain variable region comprises a CDR1, a CDR2, and a CDR3 sequence set forth in SEQ ID NO:309, SEQ ID NO:310, and SEQ ID NO:489, respectively; and the light chain variable region comprises a CDR1, a CDR2, and a CDR3 sequence set forth in SEQ ID NO:490, SEQ ID NO:313, and SEQ ID NO:491, respectively.

10. The antibody or antigen-binding fragment thereof of claim 2, wherein the light chain variable region comprises the amino acid sequence set forth in SEQ ID NO:143; and the heavy chain variable region comprises the amino acid sequence set forth in SEQ ID NO:144.

11. The antibody or antigen-binding fragment thereof of claim 2, wherein the light chain variable region comprises the amino acid sequence set forth in SEQ ID NO:215; and the heavy chain variable region comprises the amino acid sequence set forth in SEQ ID NO:216.

12. The antibody or antigen-binding fragment thereof of claim 2, wherein the light chain variable region comprises the amino acid sequence set forth in SEQ ID NO:219; and the heavy chain variable region comprises the amino acid sequence set forth in SEQ ID NO:220.

13. The antibody or antigen-binding fragment thereof of claim 2, wherein the light chain variable region comprises the amino acid sequence set forth in SEQ ID NO:235; and the heavy chain variable region comprises the amino acid sequence set forth in SEQ ID NO:236.

14. The antibody or antigen-binding fragment thereof of claim 2, wherein the light chain variable region comprises the amino acid sequence set forth in SEQ ID NO:267; and the heavy chain variable region comprises the amino acid sequence set forth in SEQ ID NO:268.

15. The antibody or antigen-binding fragment thereof of claim 2, wherein the light chain variable region comprises the amino acid sequence set forth in SEQ ID NO:115; and the heavy chain variable region comprises the amino acid sequence set forth in SEQ ID NO:116.

16. The antibody or antigen-binding fragment thereof of claim 2, wherein the light chain variable region comprises the amino acid sequence set forth in SEQ ID NO:171; and the heavy chain variable region comprises the amino acid sequence set forth in SEQ ID NO:172.

17. The antibody or antigen-binding fragment thereof of claim 2, wherein the antigen-binding fragment is an scFv.

18. A composition comprising the antibody or antigen-binding fragment thereof of claim 1, and a pharmaceutically acceptable carrier.

19. A composition comprising the antibody or antigen-binding fragment thereof of claim 2, and a pharmaceutically acceptable carrier.

20. The antibody or antigen-binding fragment thereof of claim 1, wherein the antigen-binding fragment is an scFv.

21. The antibody or antigen-binding fragment thereof of claim 20, further comprising a peptide linker, wherein the antibody or antigen-binding fragment thereof comprises the amino acid sequence set forth in SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, or SEQ ID NO:744.

22. The antibody or antigen-binding fragment thereof of claim 21, wherein the antibody or antigen-binding fragment thereof comprises the amino acid sequence set forth in SEQ ID NO: 650, SEQ ID NO:664, SEQ ID NO:678, SEQ ID NO:700, SEQ ID NO:702, SEQ ID NO:710, or SEQ ID NO:726.

23. An anti-Fc Receptor-Like 5 (FcRL5) antibody or an antigen-binding fragment thereof comprising:
(aa) a light chain variable region comprising a CDR1, a CDR2, and a CDR3 of the light chain variable region sequence set forth in SEQ ID NO:3, and a heavy chain variable region comprising a CDR1, a CDR2, and a CDR3 of the heavy chain variable region sequence set forth in SEQ ID NO:4;
(ab) a light chain variable region comprising a CDR1, a CDR2, and a CDR3 of the light chain variable region sequence set forth in SEQ ID NO:7, and a heavy chain variable region comprising a CDR1, a CDR2, and a CDR3 of the heavy chain variable region sequence set forth in SEQ ID NO:8;
(ac) a light chain variable region comprising a CDR1, a CDR2, and a CDR3 of the light chain variable region sequence set forth in SEQ ID NO:11, and a heavy chain variable region comprising a CDR1, a CDR2, and a CDR3 of the heavy chain variable region sequence set forth in SEQ ID NO:12;
(ad) a light chain variable region comprising a CDR1, a CDR2, and a CDR3 of the light chain variable region sequence set forth in SEQ ID NO:299, and a heavy chain variable region comprising a CDR1, a CDR2, and a CDR3 of the heavy chain variable region sequence set forth in SEQ ID NO:300;
(ae) a light chain variable region comprising a CDR1, a CDR2, and a CDR3 of the light chain variable region sequence set forth in SEQ ID NO:15, and a heavy chain variable region comprising a CDR1, a CDR2, and a CDR3 of the heavy chain variable region sequence set forth in SEQ ID NO:16;
(af) a light chain variable region comprising a CDR1, a CDR2, and a CDR3 of the light chain variable region sequence set forth in SEQ ID NO:19, and a heavy chain variable region comprising a CDR1, a CDR2, and a CDR3 of the heavy chain variable region sequence set forth in SEQ ID NO:20;
(ag) a light chain variable region comprising a CDR1, a CDR2, and a CDR3 of the light chain variable region sequence set forth in SEQ ID NO:23, and a heavy chain variable region comprising a CDR1, a CDR2, and a CDR3 of the heavy chain variable region sequence set forth in SEQ ID NO:24;
(ah) a light chain variable region comprising a CDR1, a CDR2, and a CDR3 of the light chain variable region sequence set forth in SEQ ID NO:27, and a heavy chain variable region comprising a CDR1, a CDR2, and a CDR3 of the heavy chain variable region sequence set forth in SEQ ID NO:28;

(ai) a light chain variable region comprising a CDR1, a CDR2, and a CDR3 of the light chain variable region sequence set forth in SEQ ID NO:31, and a heavy chain variable region comprising a CDR1, a CDR2, and a CDR3 of the heavy chain variable region sequence set forth in SEQ ID NO:32;

(aj) a light chain variable region comprising a CDR1, a CDR2, and a CDR3 of the light chain variable region sequence set forth in SEQ ID NO:35, and a heavy chain variable region comprising a CDR1, a CDR2, and a CDR3 of the heavy chain variable region sequence set forth in SEQ ID NO:36;

(ak) a light chain variable region comprising a CDR1, a CDR2, and a CDR3 of the light chain variable region sequence set forth in SEQ ID NO:39, and a heavy chain variable region comprising a CDR1, a CDR2, and a CDR3 of the heavy chain variable region sequence set forth in SEQ ID NO:40;

(al) a light chain variable region comprising a CDR1, a CDR2, and a CDR3 of the light chain variable region sequence set forth in SEQ ID NO:43, and a heavy chain variable region comprising a CDR1, a CDR2, and a CDR3 of the heavy chain variable region sequence set forth in SEQ ID NO:44;

(am) a light chain variable region comprising a CDR1, a CDR2, and a CDR3 of the light chain variable region sequence set forth in SEQ ID NO:47, and a heavy chain variable region comprising a CDR1, a CDR2, and a CDR3 of the heavy chain variable region sequence set forth in SEQ ID NO:48;

(an) a light chain variable region comprising a CDR1, a CDR2, and a CDR3 of the light chain variable region sequence set forth in SEQ ID NO:51, and a heavy chain variable region comprising a CDR1, a CDR2, and a CDR3 of the heavy chain variable region sequence set forth in SEQ ID NO:52;

(ao) a light chain variable region comprising a CDR1, a CDR2, and a CDR3 of the light chain variable region sequence set forth in SEQ ID NO:55, and a heavy chain variable region comprising a CDR1, a CDR2, and a CDR3 of the heavy chain variable region sequence set forth in SEQ ID NO:56;

(ap) a light chain variable region comprising a CDR1, a CDR2, and a CDR3 of the light chain variable region sequence set forth in SEQ ID NO:59, and a heavy chain variable region comprising a CDR1, a CDR2, and a CDR3 of the heavy chain variable region sequence set forth in SEQ ID NO:60;

(aq) a light chain variable region comprising a CDR1, a CDR2, and a CDR3 of the light chain variable region sequence set forth in SEQ ID NO:63, and a heavy chain variable region comprising a CDR1, a CDR2, and a CDR3 of the heavy chain variable region sequence set forth in SEQ ID NO:64;

(ar) a light chain variable region comprising a CDR1, a CDR2, and a CDR3 of the light chain variable region sequence set forth in SEQ ID NO:67, and a heavy chain variable region comprising a CDR1, a CDR2, and a CDR3 of the heavy chain variable region sequence set forth in SEQ ID NO:68;

(as) a light chain variable region comprising a CDR1, a CDR2, and a CDR3 of the light chain variable region sequence set forth in SEQ ID NO:71, and a heavy chain variable region comprising a CDR1, a CDR2, and a CDR3 of the heavy chain variable region sequence set forth in SEQ ID NO:72;

(at) a light chain variable region comprising a CDR1, a CDR2, and a CDR3 of the light chain variable region sequence set forth in SEQ ID NO:75, and a heavy chain variable region comprising a CDR1, a CDR2, and a CDR3 of the heavy chain variable region sequence set forth in SEQ ID NO:76;

(au) a light chain variable region comprising a CDR1, a CDR2, and a CDR3 of the light chain variable region sequence set forth in SEQ ID NO:79, and a heavy chain variable region comprising a CDR1, a CDR2, and a CDR3 of the heavy chain variable region sequence set forth in SEQ ID NO:80;

(av) a light chain variable region comprising a CDR1, a CDR2, and a CDR3 of the light chain variable region sequence set forth in SEQ ID NO:83, and a heavy chain variable region comprising a CDR1, a CDR2, and a CDR3 of the heavy chain variable region sequence set forth in SEQ ID NO:84;

(aw) a light chain variable region comprising a CDR1, a CDR2, and a CDR3 of the light chain variable region sequence set forth in SEQ ID NO:87, and a heavy chain variable region comprising a CDR1, a CDR2, and a CDR3 of the heavy chain variable region sequence set forth in SEQ ID NO:88;

(ax) a light chain variable region comprising a CDR1, a CDR2, and a CDR3 of the light chain variable region sequence set forth in SEQ ID NO:91, and a heavy chain variable region comprising a CDR1, a CDR2, and a CDR3 of the heavy chain variable region sequence set forth in SEQ ID NO:92;

(ay) a light chain variable region comprising a CDR1, a CDR2, and a CDR3 of the light chain variable region sequence set forth in SEQ ID NO:95, and a heavy chain variable region comprising a CDR1, a CDR2, and a CDR3 of the heavy chain variable region sequence set forth in SEQ ID NO:96;

(az) a light chain variable region comprising a CDR1, a CDR2, and a CDR3 of the light chain variable region sequence set forth in SEQ ID NO:99, and a heavy chain variable region comprising a CDR1, a CDR2, and a CDR3 of the heavy chain variable region sequence set forth in SEQ ID NO:100;

(ba) a light chain variable region comprising a CDR1, a CDR2, and a CDR3 of the light chain variable region sequence set forth in SEQ ID NO:103, and a heavy chain variable region comprising a CDR1, a CDR2, and a CDR3 of the heavy chain variable region sequence set forth in SEQ ID NO:104;

(bb) a light chain variable region comprising a CDR1, a CDR2, and a CDR3 of the light chain variable region sequence set forth in SEQ ID NO:107, and a heavy chain variable region comprising a CDR1, a CDR2, and a CDR3 of the heavy chain variable region sequence set forth in SEQ ID NO:108;

(bc) a light chain variable region comprising a CDR1, a CDR2, and a CDR3 of the light chain variable region sequence set forth in SEQ ID NO:111, and a heavy chain variable region comprising a CDR1, a CDR2, and a CDR3 of the heavy chain variable region sequence set forth in SEQ ID NO:112;

(bd) a light chain variable region comprising a CDR1, a CDR2, and a CDR3 of the light chain variable region sequence set forth in SEQ ID NO:115, and a heavy chain variable region comprising a CDR1, a CDR2, and a CDR3 of the heavy chain variable region sequence set forth in SEQ ID NO:116;
- (be) a light chain variable region comprising a CDR1, a CDR2, and a CDR3 of the light chain variable region sequence set forth in SEQ ID NO:119, and a heavy chain variable region comprising a CDR1, a CDR2, and a CDR3 of the heavy chain variable region sequence set forth in SEQ ID NO:120;
- (bf) a light chain variable region comprising a CDR1, a CDR2, and a CDR3 of the light chain variable region sequence set forth in SEQ ID NO:123, and a heavy chain variable region comprising a CDR1, a CDR2, and a CDR3 of the heavy chain variable region sequence set forth in SEQ ID NO:124;
- (bg) a light chain variable region comprising a CDR1, a CDR2, and a CDR3 of the light chain variable region sequence set forth in SEQ ID NO:127, and a heavy chain variable region comprising a CDR1, a CDR2, and a CDR3 of the heavy chain variable region sequence set forth in SEQ ID NO:128;
- (bh) a light chain variable region comprising a CDR1, a CDR2, and a CDR3 of the light chain variable region sequence set forth in SEQ ID NO:131, and a heavy chain variable region comprising a CDR1, a CDR2, and a CDR3 of the heavy chain variable region sequence set forth in SEQ ID NO:132;
- (bi) a light chain variable region comprising a CDR1, a CDR2, and a CDR3 of the light chain variable region sequence set forth in SEQ ID NO:135, and a heavy chain variable region comprising a CDR1, a CDR2, and a CDR3 of the heavy chain variable region sequence set forth in SEQ ID NO:136;
- (bj) a light chain variable region comprising a CDR1, a CDR2, and a CDR3 of the light chain variable region sequence set forth in SEQ ID NO:139, and a heavy chain variable region comprising a CDR1, a CDR2, and a CDR3 of the heavy chain variable region sequence set forth in SEQ ID NO:140;
- (bk) a light chain variable region comprising a CDR1, a CDR2, and a CDR3 of the light chain variable region sequence set forth in SEQ ID NO:143, and a heavy chain variable region comprising a CDR1, a CDR2, and a CDR3 of the heavy chain variable region sequence set forth in SEQ ID NO:144;
- (bl) a light chain variable region comprising a CDR1, a CDR2, and a CDR3 of the light chain variable region sequence set forth in SEQ ID NO:147, and a heavy chain variable region comprising a CDR1, a CDR2, and a CDR3 of the heavy chain variable region sequence set forth in SEQ ID NO:148;
- (bm) a light chain variable region comprising a CDR1, a CDR2, and a CDR3 of the light chain variable region sequence set forth in SEQ ID NO:151, and a heavy chain variable region comprising a CDR1, a CDR2, and a CDR3 of the heavy chain variable region sequence set forth in SEQ ID NO:152;
- (bn) a light chain variable region comprising a CDR1, a CDR2, and a CDR3 of the light chain variable region sequence set forth in SEQ ID NO:155, and a heavy chain variable region comprising a CDR1, a CDR2, and a CDR3 of the heavy chain variable region sequence set forth in SEQ ID NO:156;
- (bo) a light chain variable region comprising a CDR1, a CDR2, and a CDR3 of the light chain variable region sequence set forth in SEQ ID NO:159, and a heavy chain variable region comprising a CDR1, a CDR2, and a CDR3 of the heavy chain variable region sequence set forth in SEQ ID NO:160;
- (bp) a light chain variable region comprising a CDR1, a CDR2, and a CDR3 of the light chain variable region sequence set forth in SEQ ID NO:163, and a heavy chain variable region comprising a CDR1, a CDR2, and a CDR3 of the heavy chain variable region sequence set forth in SEQ ID NO:164;
- (bq) a light chain variable region comprising a CDR1, a CDR2, and a CDR3 of the light chain variable region sequence set forth in SEQ ID NO:167, and a heavy chain variable region comprising a CDR1, a CDR2, and a CDR3 of the heavy chain variable region sequence set forth in SEQ ID NO:168;
- (br) a light chain variable region comprising a CDR1, a CDR2, and a CDR3 of the light chain variable region sequence set forth in SEQ ID NO:171, and a heavy chain variable region comprising a CDR1, a CDR2, and a CDR3 of the heavy chain variable region sequence set forth in SEQ ID NO:172;
- (bs) a light chain variable region comprising a CDR1, a CDR2, and a CDR3 of the light chain variable region sequence set forth in SEQ ID NO:175, and a heavy chain variable region comprising a CDR1, a CDR2, and a CDR3 of the heavy chain variable region sequence set forth in SEQ ID NO:176;
- (bt) a light chain variable region comprising a CDR1, a CDR2, and a CDR3 of the light chain variable region sequence set forth in SEQ ID NO:179, and a heavy chain variable region comprising a CDR1, a CDR2, and a CDR3 of the heavy chain variable region sequence set forth in SEQ ID NO:180;
- (bu) a light chain variable region comprising a CDR1, a CDR2, and a CDR3 of the light chain variable region sequence set forth in SEQ ID NO:183, and a heavy chain variable region comprising a CDR1, a CDR2, and a CDR3 of the heavy chain variable region sequence set forth in SEQ ID NO:184;
- (bv) a light chain variable region comprising a CDR1, a CDR2, and a CDR3 of the light chain variable region sequence set forth in SEQ ID NO:187, and a heavy chain variable region comprising a CDR1, a CDR2, and a CDR3 of the heavy chain variable region sequence set forth in SEQ ID NO:188;
- (bw) a light chain variable region comprising a CDR1, a CDR2, and a CDR3 of the light chain variable region sequence set forth in SEQ ID NO:191, and a heavy chain variable region comprising a CDR1, a CDR2, and a CDR3 of the heavy chain variable region sequence set forth in SEQ ID NO:192;
- (bx) a light chain variable region comprising a CDR1, a CDR2, and a CDR3 of the light chain variable region sequence set forth in SEQ ID NO:195, and a heavy chain variable region comprising a CDR1, a CDR2, and a CDR3 of the heavy chain variable region sequence set forth in SEQ ID NO:196;
- (by) a light chain variable region comprising a CDR1, a CDR2, and a CDR3 of the light chain variable region sequence set forth in SEQ ID NO:199, and a heavy chain variable region comprising a CDR1, a CDR2, and a CDR3 of the heavy chain variable region sequence set forth in SEQ ID NO:200;
- (bz) a light chain variable region comprising a CDR1, a CDR2, and a CDR3 of the light chain variable region sequence set forth in SEQ ID NO:203, and a heavy chain variable region comprising a CDR1, a CDR2, and a CDR3 of the heavy chain variable region sequence set forth in SEQ ID NO:204;

(ca) a light chain variable region comprising a CDR1, a CDR2, and a CDR3 of the light chain variable region sequence set forth in SEQ ID NO:207, and a heavy chain variable region comprising a CDR1, a CDR2, and a CDR3 of the heavy chain variable region sequence set forth in SEQ ID NO:208;

(cb) a light chain variable region comprising a CDR1, a CDR2, and a CDR3 of the light chain variable region sequence set forth in SEQ ID NO:211, and a heavy chain variable region comprising a CDR1, a CDR2, and a CDR3 of the heavy chain variable region sequence set forth in SEQ ID NO:212;

(cc) a light chain variable region comprising a CDR1, a CDR2, and a CDR3 of the light chain variable region sequence set forth in SEQ ID NO:215, and a heavy chain variable region comprising a CDR1, a CDR2, and a CDR3 of the heavy chain variable region sequence set forth in SEQ ID NO:216;

(cd) a light chain variable region comprising a CDR1, a CDR2, and a CDR3 of the light chain variable region sequence set forth in SEQ ID NO:219, and a heavy chain variable region comprising a CDR1, a CDR2, and a CDR3 of the heavy chain variable region sequence set forth in SEQ ID NO:220;

(ce) a light chain variable region comprising a CDR1, a CDR2, and a CDR3 of the light chain variable region sequence set forth in SEQ ID NO:223, and a heavy chain variable region comprising a CDR1, a CDR2, and a CDR3 of the heavy chain variable region sequence set forth in SEQ ID NO:224;

(cf) a light chain variable region comprising a CDR1, a CDR2, and a CDR3 of the light chain variable region sequence set forth in SEQ ID NO:227, and a heavy chain variable region comprising a CDR1, a CDR2, and a CDR3 of the heavy chain variable region sequence set forth in SEQ ID NO:228;

(cg) a light chain variable region comprising a CDR1, a CDR2, and a CDR3 of the light chain variable region sequence set forth in SEQ ID NO:231, and a heavy chain variable region comprising a CDR1, a CDR2, and a CDR3 of the heavy chain variable region sequence set forth in SEQ ID NO:232;

(ch) a light chain variable region comprising a CDR1, a CDR2, and a CDR3 of the light chain variable region sequence set forth in SEQ ID NO:235, and a heavy chain variable region comprising a CDR1, a CDR2, and a CDR3 of the heavy chain variable region sequence set forth in SEQ ID NO:236;

(ci) a light chain variable region comprising a CDR1, a CDR2, and a CDR3 of the light chain variable region sequence set forth in SEQ ID NO:239, and a heavy chain variable region comprising a CDR1, a CDR2, and a CDR3 of the heavy chain variable region sequence set forth in SEQ ID NO:240;

(cj) a light chain variable region comprising a CDR1, a CDR2, and a CDR3 of the light chain variable region sequence set forth in SEQ ID NO:243, and a heavy chain variable region comprising a CDR1, a CDR2, and a CDR3 of the heavy chain variable region sequence set forth in SEQ ID NO:244;

(ck) a light chain variable region comprising a CDR1, a CDR2, and a CDR3 of the light chain variable region sequence set forth in SEQ ID NO:247, and a heavy chain variable region comprising a CDR1, a CDR2, and a CDR3 of the heavy chain variable region sequence set forth in SEQ ID NO:248;

(cl) a light chain variable region comprising a CDR1, a CDR2, and a CDR3 of the light chain variable region sequence set forth in SEQ ID NO:251, and a heavy chain variable region comprising a CDR1, a CDR2, and a CDR3 of the heavy chain variable region sequence set forth in SEQ ID NO:252;

(cm) a light chain variable region comprising a CDR1, a CDR2, and a CDR3 of the light chain variable region sequence set forth in SEQ ID NO:255, and a heavy chain variable region comprising a CDR1, a CDR2, and a CDR3 of the heavy chain variable region sequence set forth in SEQ ID NO:256;

(cn) a light chain variable region comprising a CDR1, a CDR2, and a CDR3 of the light chain variable region sequence set forth in SEQ ID NO:259, and a heavy chain variable region comprising a CDR1, a CDR2, and a CDR3 of the heavy chain variable region sequence set forth in SEQ ID NO:260;

(co) a light chain variable region comprising a CDR1, a CDR2, and a CDR3 of the light chain variable region sequence set forth in SEQ ID NO:263, and a heavy chain variable region comprising a CDR1, a CDR2, and a CDR3 of the heavy chain variable region sequence set forth in SEQ ID NO:264;

(cp) a light chain variable region comprising a CDR1, a CDR2, and a CDR3 of the light chain variable region sequence set forth in SEQ ID NO:267, and a heavy chain variable region comprising a CDR1, a CDR2, and a CDR3 of the heavy chain variable region sequence set forth in SEQ ID NO:268;

(cq) a light chain variable region comprising a CDR1, a CDR2, and a CDR3 of the light chain variable region sequence set forth in SEQ ID NO:271, and a heavy chain variable region comprising a CDR1, a CDR2, and a CDR3 of the heavy chain variable region sequence set forth in SEQ ID NO:272;

(cr) a light chain variable region comprising a CDR1, a CDR2, and a CDR3 of the light chain variable region sequence set forth in SEQ ID NO:275, and a heavy chain variable region comprising a CDR1, a CDR2, and a CDR3 of the heavy chain variable region sequence set forth in SEQ ID NO:276;

(cs) a light chain variable region comprising a CDR1, a CDR2, and a CDR3 of the light chain variable region sequence set forth in SEQ ID NO:279, and a heavy chain variable region comprising a CDR1, a CDR2, and a CDR3 of the heavy chain variable region sequence set forth in SEQ ID NO:280;

(ct) a light chain variable region comprising a CDR1, a CDR2, and a CDR3 of the light chain variable region sequence set forth in SEQ ID NO:283, and a heavy chain variable region comprising a CDR1, a CDR2, and a CDR3 of the heavy chain variable region sequence set forth in SEQ ID NO:284;

(cu) a light chain variable region comprising a CDR1, a CDR2, and a CDR3 of the light chain variable region sequence set forth in SEQ ID NO:287, and a heavy chain variable region comprising a CDR1, a CDR2, and a CDR3 of the heavy chain variable region sequence set forth in SEQ ID NO:288;

(cv) a light chain variable region comprising a CDR1, a CDR2, and a CDR3 of the light chain variable region sequence set forth in SEQ ID NO:291, and a heavy chain variable region comprising a CDR1, a CDR2, and a CDR3 of the heavy chain variable region sequence set forth in SEQ ID NO:292;
(cw) a light chain variable region comprising a CDR1, a CDR2, and a CDR3 of the light chain variable region sequence set forth in SEQ ID NO:303, and a heavy chain variable region comprising a CDR1, a CDR2, and a CDR3 of the heavy chain variable region sequence set forth in SEQ ID NO:304; or
(cx) a light chain variable region comprising a CDR1, a CDR2, and a CDR3 of the light chain variable region sequence set forth in SEQ ID NO:295, and a heavy chain variable region comprising a CDR1, a CDR2, and a CDR3 of the heavy chain variable region sequence set forth in SEQ ID NO:296.

24. The antibody or antigen-binding fragment thereof of claim 23, wherein:
(aa) the light chain variable region comprises an amino acid sequence that has at least about 90% sequence identity to the sequence set forth in SEQ ID NO:3, and the heavy chain variable region comprises an amino acid sequence that has at least about 90% sequence identity to the sequence set forth in SEQ ID NO:4;
(ab) the light chain variable region comprises an amino acid sequence that has at least about 90% sequence identity to the sequence set forth in SEQ ID NO:7, and the heavy chain variable region comprises an amino acid sequence that has at least about 90% sequence identity to the sequence set forth in SEQ ID NO:8;
(ac) the light chain variable region comprises an amino acid sequence that has at least about 90% sequence identity to the sequence set forth in SEQ ID NO:11, and the heavy chain variable region comprises an amino acid sequence that has at least about 90% sequence identity to the sequence set forth in SEQ ID NO:12;
(ad) the light chain variable region comprises an amino acid sequence that has at least about 90% sequence identity to the sequence set forth in SEQ ID NO:299, and the heavy chain variable region comprises an amino acid sequence that has at least about 90% sequence identity to the sequence set forth in SEQ ID NO:300;
(ae) the light chain variable region comprises an amino acid sequence that has at least about 90% sequence identity to the sequence set forth in SEQ ID NO:15, and the heavy chain variable region comprises an amino acid sequence that has at least about 90% sequence identity to the sequence set forth in SEQ ID NO:16;
(af) the light chain variable region comprises an amino acid sequence that has at least about 90% sequence identity to the sequence set forth in SEQ ID NO:19, and the heavy chain variable region comprises an amino acid sequence that has at least about 90% sequence identity to the sequence set forth in SEQ ID NO:20;
(ag) the light chain variable region comprises an amino acid sequence that has at least about 90% sequence identity to the sequence set forth in SEQ ID NO:23, and the heavy chain variable region comprises an amino acid sequence that has at least about 90% sequence identity to the sequence set forth in SEQ ID NO:24;
(ah) the light chain variable region comprises an amino acid sequence that has at least about 90% sequence identity to the sequence set forth in SEQ ID NO:27, and the heavy chain variable region comprises an amino acid sequence that has at least about 90% sequence identity to the sequence set forth in SEQ ID NO:28;
(ai) the light chain variable region comprises an amino acid sequence that has at least about 90% sequence identity to the sequence set forth in SEQ ID NO:31, and the heavy chain variable region comprises an amino acid sequence that has at least about 90% sequence identity to the sequence set forth in SEQ ID NO:32;
(aj) the light chain variable region comprises an amino acid sequence that has at least about 90% sequence identity to the sequence set forth in SEQ ID NO:35, and the heavy chain variable region comprises an amino acid sequence that has at least about 90% sequence identity to the sequence set forth in SEQ ID NO:36;
(ak) the light chain variable region comprises an amino acid sequence that has at least about 90% sequence identity to the sequence set forth in SEQ ID NO:39, and the heavy chain variable region comprises an amino acid sequence that has at least about 90% sequence identity to the sequence set forth in SEQ ID NO:40;
(al) the light chain variable region comprises an amino acid sequence that has at least about 90% sequence identity to the sequence set forth in SEQ ID NO:43, and the heavy chain variable region comprises an amino acid sequence that has at least about 90% sequence identity to the sequence set forth in SEQ ID NO:44;
(am) the light chain variable region comprises an amino acid sequence that has at least about 90% sequence identity to the sequence set forth in SEQ ID NO:47, and the heavy chain variable region comprises an amino acid sequence that has at least about 90% sequence identity to the sequence set forth in SEQ ID NO:48;
(an) the light chain variable region comprises an amino acid sequence that has at least about 90% sequence identity to the sequence set forth in SEQ ID NO:51, and the heavy chain variable region comprises an amino acid sequence that has at least about 90% sequence identity to the sequence set forth in SEQ ID NO:52;
(ao) the light chain variable region comprises an amino acid sequence that has at least about 90% sequence identity to the sequence set forth in SEQ ID NO:55, and the heavy chain variable region comprises an amino acid sequence that has at least about 90% sequence identity to the sequence set forth in SEQ ID NO:56;
(ap) the light chain variable region comprises an amino acid sequence that has at least about 90% sequence identity to the sequence set forth in SEQ ID NO:59, and the heavy chain variable region comprises an amino acid sequence that has at least about 90% sequence identity to the sequence set forth in SEQ ID NO:60;
(aq) the light chain variable region comprises an amino acid sequence that has at least about 90% sequence identity to the sequence set forth in SEQ ID NO:63, and the heavy chain variable region comprises an amino acid sequence that has at least about 90% sequence identity to the sequence set forth in SEQ ID NO:64;
(ar) the light chain variable region comprises an amino acid sequence that has at least about 90% sequence identity to the sequence set forth in SEQ ID NO:67, and the heavy chain variable region comprises an amino acid sequence that has at least about 90% sequence identity to the sequence set forth in SEQ ID NO:68;
(as) the light chain variable region comprises an amino acid sequence that has at least about 90% sequence identity to the sequence set forth in SEQ ID NO:71, and the heavy chain variable region comprises an amino acid sequence that has at least about 90% sequence identity to the sequence set forth in SEQ ID NO:72;

(at) the light chain variable region comprises an amino acid sequence that has at least about 90% sequence identity to the sequence set forth in SEQ ID NO:75, and the heavy chain variable region comprises an amino acid sequence that has at least about 90% sequence identity to the sequence set forth in SEQ ID NO:76;

(au) the light chain variable region comprises an amino acid sequence that has at least about 90% sequence identity to the sequence set forth in SEQ ID NO:79, and the heavy chain variable region comprises an amino acid sequence that has at least about 90% sequence identity to the sequence set forth in SEQ ID NO:80;

(av) the light chain variable region comprises an amino acid sequence that has at least about 90% sequence identity to the sequence set forth in SEQ ID NO:83, and the heavy chain variable region comprises an amino acid sequence that has at least about 90% sequence identity to the sequence set forth in SEQ ID NO:84;

(aw) the light chain variable region comprises an amino acid sequence that has at least about 90% sequence identity to the sequence set forth in SEQ ID NO:87, and the heavy chain variable region comprises an amino acid sequence that has at least about 90% sequence identity to the sequence set forth in SEQ ID NO:88;

(ax) the light chain variable region comprises an amino acid sequence that has at least about 90% sequence identity to the sequence set forth in SEQ ID NO:91, and the heavy chain variable region comprises an amino acid sequence that has at least about 90% sequence identity to the sequence set forth in SEQ ID NO:92;

(ay) the light chain variable region comprises an amino acid sequence that has at least about 90% sequence identity to the sequence set forth in SEQ ID NO:95, and the heavy chain variable region comprises an amino acid sequence that has at least about 90% sequence identity to the sequence set forth in SEQ ID NO:96;

(az) the light chain variable region comprises an amino acid sequence that has at least about 90% sequence identity to the sequence set forth in SEQ ID NO:99, and the heavy chain variable region comprises an amino acid sequence that has at least about 90% sequence identity to the sequence set forth in SEQ ID NO:100;

(ba) the light chain variable region comprises an amino acid sequence that has at least about 90% sequence identity to the sequence set forth in SEQ ID NO:103, and the heavy chain variable region comprises an amino acid sequence that has at least about 90% sequence identity to the sequence set forth in SEQ ID NO:104;

(bb) the light chain variable region comprises an amino acid sequence that has at least about 90% sequence identity to the sequence set forth in SEQ ID NO:107, and the heavy chain variable region comprises an amino acid sequence that has at least about 90% sequence identity to the sequence set forth in SEQ ID NO:108;

(bc) the light chain variable region comprises an amino acid sequence that has at least about 90% sequence identity to the sequence set forth in SEQ ID NO:111, and the heavy chain variable region comprises an amino acid sequence that has at least about 90% sequence identity to the sequence set forth in SEQ ID NO:112;

(bd) the light chain variable region comprises an amino acid sequence that has at least about 90% sequence identity to the sequence set forth in SEQ ID NO:115, and the heavy chain variable region comprises an amino acid sequence that has at least about 90% sequence identity to the sequence set forth in SEQ ID NO:116;

(be) the light chain variable region comprises an amino acid sequence that has at least about 90% sequence identity to the sequence set forth in SEQ ID NO:119, and the heavy chain variable region comprises an amino acid sequence that has at least about 90% sequence identity to the sequence set forth in SEQ ID NO:120;

(bf) the light chain variable region comprises an amino acid sequence that has at least about 90% sequence identity to the sequence set forth in SEQ ID NO:123, and the heavy chain variable region comprises an amino acid sequence that has at least about 90% sequence identity to the sequence set forth in SEQ ID NO:124;

(bg) the light chain variable region comprises an amino acid sequence that has at least about 90% sequence identity to the sequence set forth in SEQ ID NO:127, and the heavy chain variable region comprises an amino acid sequence that has at least about 90% sequence identity to the sequence set forth in SEQ ID NO:128;

(bh) the light chain variable region comprises an amino acid sequence that has at least about 90% sequence identity to the sequence set forth in SEQ ID NO:131, and the heavy chain variable region comprises an amino acid sequence that has at least about 90% sequence identity to the sequence set forth in SEQ ID NO:132;

(bi) the light chain variable region comprises an amino acid sequence that has at least about 90% sequence identity to the sequence set forth in SEQ ID NO:135, and the heavy chain variable region comprises an amino acid sequence that has at least about 90% sequence identity to the sequence set forth in SEQ ID NO:136;

(bj) the light chain variable region comprises an amino acid sequence that has at least about 90% sequence identity to the sequence set forth in SEQ ID NO:139, and the heavy chain variable region comprises an amino acid sequence that has at least about 90% sequence identity to the sequence set forth in SEQ ID NO:140;

(bk) the light chain variable region comprises an amino acid sequence that has at least about 90% sequence identity to the sequence set forth in SEQ ID NO:143, and the heavy chain variable region comprises an amino acid sequence that has at least about 90% sequence identity to the sequence set forth in SEQ ID NO:144;

(bl) the light chain variable region comprises an amino acid sequence that has at least about 90% sequence identity to the sequence set forth in SEQ ID NO:147, and the heavy chain variable region comprises an amino acid sequence that has at least about 90% sequence identity to the sequence set forth in SEQ ID NO:148;

(bm) the light chain variable region comprises an amino acid sequence that has at least about 90% sequence identity to the sequence set forth in SEQ ID NO:151, and the heavy chain variable region comprises an amino acid sequence that has at least about 90% sequence identity to the sequence set forth in SEQ ID NO:152;

(bn) the light chain variable region comprises an amino acid sequence that has at least about 90% sequence identity to the sequence set forth in SEQ ID NO:155, and the heavy chain variable region comprises an amino acid sequence that has at least about 90% sequence identity to the sequence set forth in SEQ ID NO:156;

(bo) the light chain variable region comprises an amino acid sequence that has at least about 90% sequence identity to the sequence set forth in SEQ ID NO:159, and the heavy chain variable region comprises an amino acid sequence that has at least about 90% sequence identity to the sequence set forth in SEQ ID NO:160;

(bp) the light chain variable region comprises an amino acid sequence that has at least about 90% sequence identity to the sequence set forth in SEQ ID NO:163, and the heavy chain variable region comprises an amino acid sequence that has at least about 90% sequence identity to the sequence set forth in SEQ ID NO:164;

(bq) the light chain variable region comprises an amino acid sequence that has at least about 90% sequence identity to the sequence set forth in SEQ ID NO:167, and the heavy chain variable region comprises an amino acid sequence that has at least about 90% sequence identity to the sequence set forth in SEQ ID NO:168;

(br) the light chain variable region comprises an amino acid sequence that has at least about 90% sequence identity to the sequence set forth in SEQ ID NO:171, and the heavy chain variable region comprises an amino acid sequence that has at least about 90% sequence identity to the sequence set forth in SEQ ID NO:172;

(bs) the light chain variable region comprises an amino acid sequence that has at least about 90% sequence identity to the sequence set forth in SEQ ID NO:175, and the heavy chain variable region comprises an amino acid sequence that has at least about 90% sequence identity to the sequence set forth in SEQ ID NO:176;

(bt) the light chain variable region comprises an amino acid sequence that has at least about 90% sequence identity to the sequence set forth in SEQ ID NO:179, and the heavy chain variable region comprises an amino acid sequence that has at least about 90% sequence identity to the sequence set forth in SEQ ID NO:180;

(bu) the light chain variable region comprises an amino acid sequence that has at least about 90% sequence identity to the sequence set forth in SEQ ID NO:183, and the heavy chain variable region comprises an amino acid sequence that has at least about 90% sequence identity to the sequence set forth in SEQ ID NO:184;

(bv) the light chain variable region comprises an amino acid sequence that has at least about 90% sequence identity to the sequence set forth in SEQ ID NO:187, and the heavy chain variable region comprises an amino acid sequence that has at least about 90% sequence identity to the sequence set forth in SEQ ID NO:188;

(bw) the light chain variable region comprises an amino acid sequence that has at least about 90% sequence identity to the sequence set forth in SEQ ID NO:191, and the heavy chain variable region comprises an amino acid sequence that has at least about 90% sequence identity to the sequence set forth in SEQ ID NO:192;

(bx) the light chain variable region comprises an amino acid sequence that has at least about 90% sequence identity to the sequence set forth in SEQ ID NO:195, and the heavy chain variable region comprises an amino acid sequence that has at least about 90% sequence identity to the sequence set forth in SEQ ID NO:196;

(by) the light chain variable region comprises an amino acid sequence that has at least about 90% sequence identity to the sequence set forth in SEQ ID NO:199, and the heavy chain variable region comprises an amino acid sequence that has at least about 90% sequence identity to the sequence set forth in SEQ ID NO:200;

(bz) the light chain variable region comprises an amino acid sequence that has at least about 90% sequence identity to the sequence set forth in SEQ ID NO:203, and the heavy chain variable region comprises an amino acid sequence that has at least about 90% sequence identity to the sequence set forth in SEQ ID NO:204;

(ca) the light chain variable region comprises an amino acid sequence that has at least about 90% sequence identity to the sequence set forth in SEQ ID NO:207, and the heavy chain variable region comprises an amino acid sequence that has at least about 90% sequence identity to the sequence set forth in SEQ ID NO:208;

(cb) the light chain variable region comprises an amino acid sequence that has at least about 90% sequence identity to the sequence set forth in SEQ ID NO:211, and the heavy chain variable region comprises an amino acid sequence that has at least about 90% sequence identity to the sequence set forth in SEQ ID NO:212;

(cc) the light chain variable region comprises an amino acid sequence that has at least about 90% sequence identity to the sequence set forth in SEQ ID NO:215, and the heavy chain variable region comprises an amino acid sequence that has at least about 90% sequence identity to the sequence set forth in SEQ ID NO:216;

(cd) the light chain variable region comprises an amino acid sequence that has at least about 90% sequence identity to the sequence set forth in SEQ ID NO:219, and the heavy chain variable region comprises an amino acid sequence that has at least about 90% sequence identity to the sequence set forth in SEQ ID NO:220;

(ce) the light chain variable region comprises an amino acid sequence that has at least about 90% sequence identity to the sequence set forth in SEQ ID NO:223, and the heavy chain variable region comprises an amino acid sequence that has at least about 90% sequence identity to the sequence set forth in SEQ ID NO:224;

(cf) the light chain variable region comprises an amino acid sequence that has at least about 90% sequence identity to the sequence set forth in SEQ ID NO:227, and the heavy chain variable region comprises an amino acid sequence that has at least about 90% sequence identity to the sequence set forth in SEQ ID NO:228;

(cg) the light chain variable region comprises an amino acid sequence that has at least about 90% sequence identity to the sequence set forth in SEQ ID NO:231, and the heavy chain variable region comprises an amino acid sequence that has at least about 90% sequence identity to the sequence set forth in SEQ ID NO:232;

(ch) the light chain variable region comprises an amino acid sequence that has at least about 90% sequence identity to the sequence set forth in SEQ ID NO:235, and the heavy chain variable region comprises an amino acid sequence that has at least about 90% sequence identity to the sequence set forth in SEQ ID NO:236;

(ci) the light chain variable region comprises an amino acid sequence that has at least about 90% sequence identity to the sequence set forth in SEQ ID NO:239, and the heavy chain variable region comprises an amino acid sequence that has at least about 90% sequence identity to the sequence set forth in SEQ ID NO:240;

(cj) the light chain variable region comprises an amino acid sequence that has at least about 90% sequence identity to the sequence set forth in SEQ ID NO:243, and the heavy chain variable region comprises an amino acid sequence that has at least about 90% sequence identity to the sequence set forth in SEQ ID NO:244;

(ck) the light chain variable region comprises an amino acid sequence that has at least about 90% sequence identity to the sequence set forth in SEQ ID NO:247, and the heavy chain variable region comprises an amino acid sequence that has at least about 90% sequence identity to the sequence set forth in SEQ ID NO:248;

(cl) the light chain variable region comprises an amino acid sequence that has at least about 90% sequence identity to the sequence set forth in SEQ ID NO:251, and the heavy chain variable region comprises an amino acid sequence that has at least about 90% sequence identity to the sequence set forth in SEQ ID NO:252;

(cm) the light chain variable region comprises an amino acid sequence that has at least about 90% sequence identity to the sequence set forth in SEQ ID NO:255, and the heavy chain variable region comprises an amino acid sequence that has at least about 90% sequence identity to the sequence set forth in SEQ ID NO:256;

(cn) the light chain variable region comprises an amino acid sequence that has at least about 90% sequence identity to the sequence set forth in SEQ ID NO:259, and the heavy chain variable region comprises an amino acid sequence that has at least about 90% sequence identity to the sequence set forth in SEQ ID NO:260;

(co) the light chain variable region comprises an amino acid sequence that has at least about 90% sequence identity to the sequence set forth in SEQ ID NO:263, and the heavy chain variable region comprises an amino acid sequence that has at least about 90% sequence identity to the sequence set forth in SEQ ID NO:264;

(cp) the light chain variable region comprises an amino acid sequence that has at least about 90% sequence identity to the sequence set forth in SEQ ID NO:267, and the heavy chain variable region comprises an amino acid sequence that has at least about 90% sequence identity to the sequence set forth in SEQ ID NO:268;

(cq) the light chain variable region comprises an amino acid sequence that has at least about 90% sequence identity to the sequence set forth in SEQ ID NO:271, and the heavy chain variable region comprises an amino acid sequence that has at least about 90% sequence identity to the sequence set forth in SEQ ID NO:272;

(cr) the light chain variable region comprises an amino acid sequence that has at least about 90% sequence identity to the sequence set forth in SEQ ID NO:275, and the heavy chain variable region comprises an amino acid sequence that has at least about 90% sequence identity to the sequence set forth in SEQ ID NO:276;

(cs) the light chain variable region comprises an amino acid sequence that has at least about 90% sequence identity to the sequence set forth in SEQ ID NO:279, and the heavy chain variable region comprises an amino acid sequence that has at least about 90% sequence identity to the sequence set forth in SEQ ID NO:280;

(ct) the light chain variable region comprises an amino acid sequence that has at least about 90% sequence identity to the sequence set forth in SEQ ID NO:283, and the heavy chain variable region comprises an amino acid sequence that has at least about 90% sequence identity to the sequence set forth in SEQ ID NO:284;

(cu) the light chain variable region comprises an amino acid sequence that has at least about 90% sequence identity to the sequence set forth in SEQ ID NO:287, and the heavy chain variable region comprises an amino acid sequence that has at least about 90% sequence identity to the sequence set forth in SEQ ID NO:288;

(cv) the light chain variable region comprises an amino acid sequence that has at least about 90% sequence identity to the sequence set forth in SEQ ID NO:291, and the heavy chain variable region comprises an amino acid sequence that has at least about 90% sequence identity to the sequence set forth in SEQ ID NO:292;

(cw) the light chain variable region comprises an amino acid sequence that has at least about 90% sequence identity to the sequence set forth in SEQ ID NO:303, and the heavy chain variable region comprises an amino acid sequence that has at least about 90% sequence identity to the sequence set forth in SEQ ID NO:304; or (cx) the light chain variable region comprises an amino acid sequence that has at least about 90% sequence identity to the sequence set forth in SEQ ID NO:295, and the heavy chain variable region comprises an amino acid sequence that has at least about 90% sequence identity to the sequence set forth in SEQ ID NO:296.

25. The antibody or antigen-binding fragment thereof of claim 23, which is a fully human or an antigen-binding fragment thereof, a chimeric antibody or an antigen-binding fragment thereof, or a humanized antibody or an antigen-binding fragment thereof.

26. The antibody or antigen-binding fragment thereof of claim 23, wherein the antigen-binding fragment is a Fab, Fab', F(ab')$_2$, Fv or single chain fragment variable (scFv).

27. The antibody or antigen-binding fragment thereof of claim 23, wherein the FcRL5 is a human FcRL5.

28. The antibody or antigen-binding fragment thereof of claim 23, wherein the antibody or antigen-binding fragment thereof binds to an epitope comprising the amino acid sequence set forth in SEQ ID NO:915 or SEQ ID NO:916.

29. A composition comprising the antibody or antigen-binding fragment thereof of claim 23, and a pharmaceutically acceptable carrier.

30. An immunoconjugate comprising the antibody or antigen-binding fragment thereof of claim 23, linked to a therapeutic agent.

31. The immunoconjugate of claim 30, wherein the therapeutic agent is a drug, cytotoxin, or a radioactive isotope.

32. A composition comprising the immunoconjugate of claim 30 and a pharmaceutically acceptable carrier.

33. A bispecific molecule comprising the antibody or antigen-binding fragment thereof of claim 23, linked to a second functional moiety.

34. The bispecific molecule of claim 33, wherein the second functional moiety has a different binding specificity than said antibody or antigen-binding fragment thereof.

35. The bispecific molecule of claim 33, wherein the second functional moiety has a binding specificity for an immune cell.

36. The bispecific molecule of claim 33, wherein the second functional moiety has a binding specificity for CD3.

37. A kit for treating a B cell cancer, comprising the antibody or antigen-binding fragment thereof of claim 23.

38. A composition comprising the bispecific molecule of claim 33 and a pharmaceutically acceptable carrier.

39. The kit of claim 37, wherein the kit further comprises written instructions for using the antibody or antigen-binding fragment thereof for treating a subject having a B cell cancer.

40. The kit of claim 37, wherein the B cell cancer is multiple myeloma or Waldenstrom's Macroglobulinemia.

41. The kit of claim 40, wherein the B cell cancer is multiple myeloma.

42. The antibody or antigen-binding fragment thereof of claim 23, wherein the antigen-binding fragment is an scFv.

43. The antibody or antigen-binding fragment thereof of claim 42, wherein the antibody or antigen-binding fragment comprises a peptide linker positioned between the light chain variable region and the heavy chain variable region.

44. The antibody or antigen-binding fragment thereof of claim 43, wherein the antibody or antigen-binding fragment comprises, in N-terminal to C-terminal order, the light chain variable region, the peptide linker and the heavy chain variable region.

* * * * *